United States Patent
Freier et al.

(10) Patent No.: US 12,281,305 B2
(45) Date of Patent: Apr. 22, 2025

(54) COMPOUNDS AND METHODS FOR REDUCING PRION EXPRESSION

(71) Applicant: Ionis Pharmaceuticals, Inc., Carlsbad, CA (US)

(72) Inventors: Susan M. Freier, San Diego, CA (US); Huynh-Hoa Bui, San Diego, CA (US); Hien Thuy Zhao, San Diego, CA (US)

(73) Assignee: Ionis Pharmaceuticals, Inc., Carlsbad, CA (US)

(*) Notice: Subject to any disclaimer, the term of this patent is extended or adjusted under 35 U.S.C. 154(b) by 815 days.

(21) Appl. No.: 17/294,859

(22) PCT Filed: Nov. 21, 2019

(86) PCT No.: PCT/US2019/062681
§ 371 (c)(1),
(2) Date: May 18, 2021

(87) PCT Pub. No.: WO2020/106996
PCT Pub. Date: May 28, 2020

(65) Prior Publication Data
US 2022/0025366 A1    Jan. 27, 2022

Related U.S. Application Data

(60) Provisional application No. 62/770,386, filed on Nov. 21, 2018.

(51) Int. Cl.
*C12N 15/113*    (2010.01)
*A61K 31/7088*    (2006.01)

(52) U.S. Cl.
CPC ........ *C12N 15/113* (2013.01); *A61K 31/7088* (2013.01); *C12N 2310/14* (2013.01); *C12N 2310/31* (2013.01); *C12N 2310/315* (2013.01); *C12N 2310/321* (2013.01); *C12N 2310/322* (2013.01); *C12N 2310/3231* (2013.01); *C12N 2310/3341* (2013.01); *C12N 2310/34* (2013.01); *C12N 2310/341* (2013.01); *C12N 2310/351* (2013.01); *C12N 2320/35* (2013.01)

(58) Field of Classification Search
CPC .............. C12N 15/113; C12N 2310/14; A61K 31/7088
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |

(Continued)

FOREIGN PATENT DOCUMENTS

| | | |
|---|---|---|
| CN | 103255142 A | 8/2013 |
| JP | 2007-252288 A | 10/2007 |

(Continued)

OTHER PUBLICATIONS

NC_000020.11, Start: 4686151, Stop: 4701588, PRNP, NCBI *Homo sapiens* Annotation Release 108, Jun. 7, 2016 (Year: 2016).*
Ostergaard et al., 2020, "Understanding the effect of controlling phosphorothioate chirality in the DNA gap on the potency and safety of gapmer antisense oligonucleotides" Nucleic Acids Research, 2020, 48(4), p. 1691-1700 (Year: 2020).*
Wan et al., 2014, "Synthesis, biophysical properties and biological activity of second generation antisense oligonucleotides containing chiral phosphorothioate linkages" Nucleic Acids Research, 42(22), p. 13456-13468 (Year: 2014).*
Wozniak and Brezinski, 2023, "Biological Catalysis and Information Storage Have Relied on N-Glycosyl Derivatives of—D-Ribofuranose since the Origins of Life" Biomolecules, 13(5), 782, p. 1-21 (Year: 2023).*

(Continued)

*Primary Examiner* — Jennifer Dunston
*Assistant Examiner* — Jenna L Persons
(74) *Attorney, Agent, or Firm* — Banner & Witcoff, LTD

(57) ABSTRACT

Provided are compounds, methods, and pharmaceutical compositions for reducing the amount or activity of PRNP RNA in a cell or animal, and in certain instances reducing the amount of PrP protein in a cell or animal. Such compounds, methods, and pharmaceutical compositions are useful to ameliorate at least one symptom or hallmark of a neurodegenerative disease. Such symptoms and hallmarks spongiform changes in the brain, development of abnormal protein aggregates, neuronal loss, markers of neuronal loss, rapidly progressing dementia, and death. Such neurodegenerative diseases include prion diseases, Creutzfeldt-Jakob disease (CJD), variant Creutzfeldt-Jakob Disease (vCJD), familial Creutzfeldt-Jakob Disease (fCJD), Gerstmann-Straussler-Scheinker syndrome, fatal familial insomnia, kuru, Alzheimer's disease, or Parkinson's disease.

29 Claims, No Drawings
Specification includes a Sequence Listing.

(56) References Cited

U.S. PATENT DOCUMENTS

| | | | |
|---|---|---|---|
| 5,220,007 | A | 6/1993 | Pederson et al. |
| 5,223,618 | A | 6/1993 | Cook et al. |
| 5,235,033 | A | 8/1993 | Summerton et al. |
| 5,256,775 | A | 10/1993 | Froehler |
| 5,264,423 | A | 11/1993 | Cohen et al. |
| 5,264,562 | A | 11/1993 | Matteucci |
| 5,264,564 | A | 11/1993 | Matteucci |
| 5,185,444 | A | 12/1993 | Summerton et al. |
| 5,276,019 | A | 1/1994 | Cohen et al. |
| 5,286,717 | A | 2/1994 | Cohen et al. |
| 5,319,080 | A | 6/1994 | Leumann |
| 5,321,131 | A | 6/1994 | Agrawal et al. |
| 5,359,044 | A | 10/1994 | Cook et al. |
| 5,366,878 | A | 11/1994 | Pederson et al. |
| 5,367,066 | A | 11/1994 | Urdea et al. |
| 5,378,825 | A | 1/1995 | Cook et al. |
| 5,386,023 | A | 1/1995 | Sanghvi et al. |
| 5,393,878 | A | 2/1995 | Leumann |
| 5,399,676 | A | 3/1995 | Froehler |
| 5,403,711 | A | 4/1995 | Walder et al. |
| 5,405,938 | A | 4/1995 | Sumerton et al. |
| 5,405,939 | A | 4/1995 | Suhadolnik et al. |
| 5,432,272 | A | 7/1995 | Benner |
| 5,434,257 | A | 7/1995 | Matteucci |
| 5,446,137 | A | 8/1995 | Maag et al. |
| 5,453,496 | A | 9/1995 | Caruthers et al. |
| 5,455,233 | A | 10/1995 | Spielvogel et al. |
| 5,457,187 | A | 10/1995 | Gmelner et al. |
| 5,457,191 | A | 10/1995 | Cook et al. |
| 5,459,255 | A | 10/1995 | Cook et al. |
| 5,466,677 | A | 11/1995 | Baxter et al. |
| 5,466,786 | A | 11/1995 | Burh et al. |
| 5,470,967 | A | 11/1995 | Huie et al. |
| 5,476,925 | A | 12/1995 | Letsinger et al. |
| 5,484,908 | A | 1/1996 | Froehler et al. |
| 5,489,677 | A | 2/1996 | Sanghvi et al. |
| 5,491,133 | A | 2/1996 | Walder et al. |
| 5,502,177 | A | 3/1996 | Matteucci et al. |
| 5,508,270 | A | 4/1996 | Baxter et al. |
| 5,514,785 | A | 5/1996 | Van Ness et al. |
| 5,519,126 | A | 5/1996 | Hecht |
| 5,519,134 | A | 5/1996 | Acevedo et al. |
| 5,525,711 | A | 6/1996 | Hawkins et al. |
| 5,527,899 | A | 6/1996 | Froehler |
| 5,536,821 | A | 7/1996 | Agrawal et al. |
| 5,541,306 | A | 7/1996 | Agrawal et al. |
| 5,541,307 | A | 7/1996 | Cook et al. |
| 5,550,111 | A | 8/1996 | Suhadolnik et al. |
| 5,552,540 | A | 9/1996 | Haralambidis |
| 5,561,225 | A | 10/1996 | Maddry et al. |
| 5,563,253 | A | 10/1996 | Agrawal et al. |
| 5,565,350 | A | 10/1996 | Kmiec |
| 5,565,555 | A | 10/1996 | Froehler et al. |
| 5,567,811 | A | 10/1996 | Mistura et al. |
| 5,571,799 | A | 11/1996 | Tkachuk et al. |
| 5,576,427 | A | 11/1996 | Cook et al. |
| 5,587,361 | A | 12/1996 | Cook et al. |
| 5,587,469 | A | 12/1996 | Cook et al. |
| 5,587,470 | A | 12/1996 | Cook et al. |
| 5,591,722 | A | 1/1997 | Montgomery et al. |
| 5,594,121 | A | 1/1997 | Froehler et al. |
| 5,596,086 | A | 1/1997 | Matteucci |
| 5,596,091 | A | 1/1997 | Switzer |
| 5,597,909 | A | 1/1997 | Urdea et al. |
| 5,602,240 | A | 2/1997 | De Mesmaeker et al. |
| 5,608,046 | A | 3/1997 | Cook et al. |
| 5,610,289 | A | 3/1997 | Cook et al. |
| 5,610,300 | A | 3/1997 | Altmann et al. |
| 5,614,617 | A | 3/1997 | Cook et al. |
| 5,618,704 | A | 4/1997 | Sanghvi et al. |
| 5,623,065 | A | 4/1997 | Cook et al. |
| 5,623,070 | A | 4/1997 | Cook et al. |
| 5,625,050 | A | 4/1997 | Beaton et al. |
| 5,627,053 | A | 5/1997 | Usman et al. |
| 5,633,360 | A | 5/1997 | Bishofberger et al. |
| 5,639,873 | A | 6/1997 | Barascut et al. |
| 5,645,985 | A | 7/1997 | Froehler et al. |
| 5,646,265 | A | 7/1997 | McGee |
| 5,646,269 | A | 7/1997 | Matteucci |
| 5,652,355 | A | 7/1997 | Metelev et al. |
| 5,652,356 | A | 7/1997 | Agrawal |
| 5,663,312 | A | 9/1997 | Chaturvedula |
| 5,670,633 | A | 9/1997 | Cook et al. |
| 5,672,697 | A | 9/1997 | Buhr et al. |
| 5,677,437 | A | 10/1997 | Teng et al. |
| 5,677,439 | A | 10/1997 | Weis et al. |
| 5,681,941 | A | 10/1997 | Cook et al. |
| 5,698,685 | A | 12/1997 | Summerton et al. |
| 5,700,920 | A | 12/1997 | Altmann et al. |
| 5,700,922 | A | 12/1997 | Cook |
| 5,721,218 | A | 2/1998 | Froehler |
| 5,750,692 | A | 5/1998 | Cook et al. |
| 5,763,588 | A | 6/1998 | Matteucci et al. |
| 5,792,608 | A | 8/1998 | Swaminathan et al. |
| 5,792,847 | A | 8/1998 | Burh et al. |
| 5,801,154 | A | 9/1998 | Baracchini et al. |
| 5,808,027 | A | 9/1998 | Cook et al. |
| 5,830,653 | A | 11/1998 | Froehler et al. |
| 5,859,221 | A | 1/1999 | Cook et al. |
| 5,948,903 | A | 9/1999 | Cook et al. |
| 5,994,517 | A | 11/1999 | Ts'O |
| 6,005,087 | A | 12/1999 | Cook et al. |
| 6,005,096 | A | 12/1999 | Matteucci et al. |
| 6,166,199 | A | 12/2000 | Cook et al. |
| 6,300,319 | B1 | 10/2001 | Manoharan |
| 6,426,220 | B1 | 7/2002 | Bennett et al. |
| 6,525,191 | B1 | 2/2003 | Ramasamy |
| 6,531,584 | B1 | 3/2003 | Cook et al. |
| 6,582,908 | B2 | 6/2003 | Fodor et al. |
| 6,600,032 | B1 | 7/2003 | Manoharan et al. |
| 6,660,720 | B2 | 12/2003 | Manoharan |
| 6,770,748 | B2 | 8/2004 | Imanishi et al. |
| 7,015,315 | B1 | 3/2006 | Cook et al. |
| 7,053,207 | B2 | 5/2006 | Wengel et al. |
| 7,101,993 | B1 | 9/2006 | Cook et al. |
| 7,250,289 | B2 | 7/2007 | Zhou |
| 7,262,177 | B2 | 8/2007 | Ts'o et al. |
| 7,399,845 | B2 | 7/2008 | Seth et al. |
| 7,427,672 | B2 | 9/2008 | Imanishi et al. |
| 7,491,805 | B2 | 2/2009 | Vargeese et al. |
| 7,547,684 | B2 | 6/2009 | Seth et al. |
| 7,569,686 | B1 | 8/2009 | Bhat et al. |
| 7,666,854 | B2 | 2/2010 | Seth et al. |
| 7,696,345 | B2 | 4/2010 | Allerson et al. |
| 7,723,509 | B2 | 5/2010 | Manoharan et al. |
| 7,741,457 | B2 | 6/2010 | Swayze et al. |
| 7,750,131 | B2 | 7/2010 | Seth et al. |
| 7,875,733 | B2 | 1/2011 | Bhat et al. |
| 7,939,677 | B2 | 5/2011 | Bhat et al. |
| 8,022,193 | B2 | 9/2011 | Swayze et al. |
| 8,030,467 | B2 | 10/2011 | Seth et al. |
| 8,080,644 | B2 | 12/2011 | Wengel et al. |
| 8,088,746 | B2 | 1/2012 | Seth et al. |
| 8,088,904 | B2 | 1/2012 | Swayze et al. |
| 8,106,022 | B2 | 1/2012 | Manoharan et al. |
| 8,124,745 | B2 | 2/2012 | Allerson et al. |
| 8,153,365 | B2 | 4/2012 | Wengel et al. |
| 8,268,980 | B2 | 9/2012 | Seth et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,440,803 | B2 | 5/2013 | Swayze et al. |
| 8,501,805 | B2 | 8/2013 | Seth et al. |
| 8,530,640 | B2 | 9/2013 | Seth et al. |
| 8,546,556 | B2 | 10/2013 | Seth et al. |
| RE44,779 | E | 2/2014 | Imanishi et al. |
| 8,669,102 | B2 * | 3/2014 | Bennett ............... A61P 25/28 435/325 |
| 8,828,956 | B2 | 9/2014 | Manoharan et al. |
| 9,005,906 | B2 | 4/2015 | Swayze et al. |
| 9,012,421 | B2 | 4/2015 | Migawa et al. |
| 9,127,276 | B2 | 8/2015 | Prakash et al. |
| 9,290,760 | B2 | 3/2016 | Rajeev et al. |
| 2001/0053519 | A1 | 12/2001 | Fodor et al. |

(56) References Cited

U.S. PATENT DOCUMENTS

| | | |
|---|---|---|
| 2002/0081645 A1 | 6/2002 | Collinge |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0014048 A1 | 1/2004 | Monia et al. |
| 2004/0171570 A1 | 9/2004 | Allerson et al. |
| 2005/0053583 A1 | 3/2005 | Sakaguchi et al. |
| 2005/0130923 A1 | 6/2005 | Bhat et al. |
| 2005/0255487 A1 | 11/2005 | Khvorova et al. |
| 2006/0148740 A1 | 7/2006 | Platenburg |
| 2006/0280745 A1 | 12/2006 | Collinge et al. |
| 2007/0031844 A1 | 2/2007 | Khvorova et al. |
| 2007/0123480 A1 | 5/2007 | Juteau et al. |
| 2008/0039618 A1 | 2/2008 | Allerson et al. |
| 2008/0085269 A1 | 4/2008 | Eisenbach-Schwartz |
| 2010/0190837 A1 | 7/2010 | Migawa et al. |
| 2010/0197762 A1 | 8/2010 | Swayze et al. |
| 2011/0269818 A1 | 11/2011 | Bennett et al. |
| 2013/0130378 A1 | 5/2013 | Manoharan et al. |
| 2014/0107330 A1 | 4/2014 | Freier et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2016/0304871 A1* | 10/2016 | Rigo ....................... A61P 25/02 |
| 2019/0381007 A1 | 12/2019 | Maccecchini |

FOREIGN PATENT DOCUMENTS

| | | |
|---|---|---|
| WO | 2005078093 A1 | 8/2005 |
| WO | WO 2010/019270 | 2/2010 |
| WO | WO 2018/007980 | 1/2018 |
| WO | WO 2020/106996 | 5/2020 |
| WO | 2023164696 A2 | 8/2023 |

OTHER PUBLICATIONS

*Homo sapiens* prion protein (PRNP), RefSeqGene on chromosome 20, NCBI Reference Sequence: NG_009087.1, Dec. 1, 2017 (Year: 2017).*

Minikel et al., Jun. 26, 2020, "Prion protein lowering is a disease-modifying therapy across prion disease stages, strains, and endpoints" bioRxiv, doi: 10.1101/2020.03.27.011940 (Year: 2020).*

Raymond et al., Jul. 30, 2019, "Antisense oligonucleotides extend survival of prion-infected mice" JCI Insight, 2019;4(16):e131175 (Year: 2019).*

Barbieri et al., "Silencing of cellular prion protein (PrPC) expression by DNA-antisense oligonucleotides induces autophagy-dependent cell death in glioma cells" Autophagy (2011) 7: 840-853.

Branch et al., "A good antisense molecule is hard to find," TIBS (1998) 23:45-50.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Crooke et al., "Basic Principles of Antisense Therapeutics" Antisense Research and Application (1998) Chapter 1:1-50.

Crooke, St., et al., "Antisense Drug Technology" Second Edition, CRC Press (2008) Chapters 1-28.

Daude et al., "Specific inhibition of pathological prion protein accumulation by small interfering RNAs" Journal of Cell Science (2003) 116(13):2775-2779.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Erana et al., "Prion-like disorders and Transmissible Spongiform Encephalopathies: An overview of the mechanistic features that are shared by the various disease-related misfolded proteins" Biochem. And Biophys. Res. Comm. (2017) 483: 1125-1136.

Ferreira et al., "α-synuclein interacts with PrPC to induce cognitive impairment through mGluR5 and NMDAR2B" *Nature Neuroscience* (2017) 20: 1569-1579.

Friberg et al., "Intracerebral Infusion of Antisense Oligonucleotides Into Prion-infected Mice" Mol The Nucl Acids (2012) 1-12.

Gautschi et al., "Activity of a novel bcl-2/bcl-xLbispecific antisense oligonucleotide against tumors of diverse histologic origins" J. Natl. Cancer Inst. (2001) 93:463-471.

Golding et al., "Suppression of prion protein in livestock by RNA interference" PNAS (2006) 103(14): 5285-5290.

International Search Report for PCT/US19/062681 dated Apr. 7, 2020.

International Search Report for application PCT/US2009/004680 dated Oct. 13, 2009.

Kapuj et al., "Phosphorothioate Oligonucleotides Reduce PrPsc Levels and Prion Infectivity in Cultured Cells" Mol Med (2007) 13(3-4): 190-198.

Maher et al., "Comparative hybrid arrest by tandem antisense oligodeoxyribonucleotides or oligodeoxyribonucleoside methylphosphonates in a cell-free system" Nucl. Acid. Res. (1998) 16(8):3341-3358.

Mastrianni"The genetics of prion diseases" *Genetic Med.* (2010) 12(4): 187-195.

New England Biolabs 1998/1999 Catalog (cover page and pp. 121 and 284).

Ohnishi et al., "Enhancement of Allele Discrimination by Introduction of Nucleotide Mismatches into siRNA in Allele-Specific Gene Silencing by RNAi" PLoS One (2008) 3(5):e2248.

Olie et al., "Analysis of ribosyl-modified, mixed backbone analogs of a bcl-2/bcl-xL antisense oligonucleotide" Biochemica et Biophysica Acta (2002) 1576: 101-109.

Orru et. al., "Rapid and sensitive RT-QuIC detection of human Creutzfeldt-Jakob disease using cerebrospinal fluid" mBio (2015) 6(1): e02451-14.

Pfeifer et al., "Lentivector-mediated RNAi efficiently suppresses prion protein and prolongs survival of scrapie-infected mice" J. Clin. Invest. (2006) 116(12):3204-3210.

Purro et al., "Prion Protein as a Toxic Acceptor of Amyloid-β Oligomers" Biol Psychoatry (2018) 83: 358-368.

Raymond et al., "Antisense oligonucleotides extend survival of prion-infected mice" JCI Insight (2019) 1-13.

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Senesi et al., "In vivo prion models and the disconnection between transmissibility and neurotoxicity" *Ageing Research Reviews* (2017) 36: 156-164.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Sutou et al., "Knockdown of the bovine prion gene PRNP by RNA interference (RNAi) technology" BMC Biotechnology (2007) 7:44 1-10.

Tilly et al., "Efficient and specific down-regulation of prion protein expression by RNAi" Biochemical and Biophysical Research Communications (2003) 305:548-551.

Vallabh "Developing an antisense drug for prion disease" downloaded from: http://www.prionalliance.org/2018/07/09/developing-an-antisense-drug-for-prion-disease/ (2018) by scientist at Broad Institute.

Weiss et al., "RNA Aptamers Specifically Interact with the Prion Protein PrP" Journal of Virology (1997) 71(11): 8790-8797.

White et al., "Single treatment with RNAi against prion protein rescues early neuronal dysfunction and prolongs survival in mice with prion diseases" PNAS (2008) 105(29):10238-10243.

Woolf et al., "Specificity of antisense oligonucleotides in vivo" PNAS (1992) 89: 7305-7309.

Extended European Search Report for 19888227.6 dated Jan. 5, 2023, 7 pages.

(56) References Cited

OTHER PUBLICATIONS

International Search Report for PCT/US23/063353 dated Jul. 31, 2023, 19 pages.

* cited by examiner

COMPOUNDS AND METHODS FOR REDUCING PRION EXPRESSION

SEQUENCE LISTING

The present application is being filed along with a Sequence Listing in electronic format. The Sequence Listing is provided as a file entitled BIOL0345USASEQ_ST25.txt, created on May 11, 2021, which is 601,804 bytes in size. The information in the electronic format of the sequence listing is incorporated herein by reference in its entirety.

FIELD

Provided are compounds, methods, and pharmaceutical compositions for reducing the amount of prion RNA (PRNP RNA) in a cell or animal, and in certain instances reducing the amount of prion protein (PrP protein) in a cell or animal. Such compounds, methods, and pharmaceutical compositions are useful to ameliorate at least one symptom or hallmark of a neurodegenerative disease. Such symptoms and hallmarks include spongiform changes in the brain, development of abnormal protein aggregates, neuronal loss, markers of neuronal loss, rapidly progressing dementia, and death. Such neurodegenerative diseases include prion diseases, Creutzfeldt-Jakob disease (CJD), variant Creutzfeldt-Jakob Disease (vCJD), familial Creutzfeldt-Jakob Disease (fCJD), Gerstmann-Straussler-Scheinker syndrome, fatal familial insomnia, kuru, Alzheimer's disease, or Parkinson's disease.

BACKGROUND

Prion diseases are a family of rare, progressive, neurodegenerative disorders that affect both humans and non-human animals. Such diseases are caused by the misfolding of the normal prion protein ("PrP$^C$") and are distinguished by long incubation periods and characteristic spongiform changes associated with neuronal loss (Senesi, et al., "In vivo prion models and the disconnection between transmissibility and neurotoxicity", *Ageing Research Reviews* 2017, 36: 156-164; Erana, et al., *Biochem. And Biophys. Res. Comm.*, "Prion-like disorders and Transmissible Spongiform Encephalopathies: An overview of the mechanistic features that are shared by the various disease-related misfolded proteins", 2017, 483: 1125-1136). Hallmarks of prion diseases include, but are not limited to, spongiform changes in the brain, development of abnormal protein aggregates, neuronal loss, and markers of neuronal loss. Symptoms of prion diseases include, but are not limited to, rapidly progressing dementia, personality changes, ataxia, hallucinations, myoclonus (muscle jerks), chorea, autonomic disturbances, impaired vision, insomnia, blindness, loss of speech, coma, and death.

Prion protein can occur in several distinct conformational states: a normal cellular form, PrP$^C$, and the protease-resistant scrapie, disease-causing form, hypothesized to represent an ensemble of misfolded conformers, collectively referred to as scrapie or disease-causing prion protein, "PrP$^{Sc}$" (Sensei, 2017). The scrapie form of the prion protein, PrP$^{Sc}$, is the causative agent of transmissible spongiform encephalopathies. Both forms of the protein have the same amino acid sequence, encoded by PRNP RNA, and differ only in how they are folded in three-dimensional space. However, certain mutations in PRNP RNA cause a predisposition of the expressed protein to adopt the folding state of the disease-causing PrP$^{Sc}$ (Mastrianni, "The genetics of prion diseases", *Genetic Med.*, 2010, 12(4):187-195). PrP$^{Sc}$ forms aggregates and is resistant to proteolytic degradation by proteinase K. The infectious PrP$^{Sc}$ can cause misfolding of normal cellular PrP$^C$, converting it to the proteinase K-resistant PrP$^{Sc}$. This causes an increase in cellular levels of PrP$^{Sc}$, leading to increased protein aggregation as well as spread of the misfolded form throughout the CNS. The patient rapidly develops the characteristic signs and symptoms of prion disease, which is always fatal.

In addition to prion disease, PrP$^C$ has also been implicated as a molecular target in synucleinopathies, such as Parkinson's disease and dementia with Lewy bodies (Ferreira, et. al., "α-synuclein interacts with PrP$^C$ to induce cognitive impairment through mGluR5 and NMDAR2B", *Nature Neuroscience*, 2017, 20:1569-157) and Alzheimer's disease (Purro, et al., "Alzheimer's", *Biological Psychiatry*, 2018, 83(4):358-368).

Both PrP$^C$ and PrP$^{Sc}$ can be detected in cerebrospinal fluid (CSF). PrP$^C$ can be detected in CSF by standard methods such as western blot. The infectious PrP$^{Sc}$ can be detected in the CSF of prion-infected patients via a RT-QuIC test (real-time quaking induced conversion), as described by Orru, et. al., *mBio*, "Rapid and sensitive RT-QuIC detection of human Creutzfeldt-Jakob disease using cerebrospinal fluid," 2015, 6(1): c02451-14. This test distinguishes PrP$^{Sc}$ from PrP$^C$ by the ability of CSF samples to induce the misfolding of a recombinant PrP substrate.

Currently there is a lack of acceptable options for treating neurodegenerative diseases. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of PRNP RNA, and in certain embodiments reducing the amount of PrP protein in a cell or animal. In certain embodiments, the animal has a neurodegenerative disease. In certain embodiments, the neurodegenerative disease is a prion disease, Creutzfeldt-Jakob disease (CJD), variant Creutzfeldt-Jakob Disease (vCJD), familial Creutzfeldt-Jakob Disease (fCJD), Gerstmann-Straussler-Scheinker syndrome (GSS), fatal familial insomnia (FFI), kuru, Alzheimer's disease, or Parkinson's disease. In certain embodiments, compounds useful for reducing expression of PRNP RNA are oligomeric compounds. In certain embodiments, compounds useful for reducing expression of PRNP RNA are modified oligonucleotides.

Also provided are methods useful for ameliorating at least one symptom or hallmark of a neurodegenerative disease. In certain embodiments, the neurodegenerative disease is a prion disease, Creutzfeldt-Jakob disease (CJD), variant Creutzfeldt-Jakob Disease (vCJD), familial Creutzfeldt-Jakob Disease (fCJD), Gerstmann-Straussler-Scheinker syndrome, fatal familial insomnia, kuru, Alzheimer's disease, or Parkinson's disease. In certain embodiments, the symptom or hallmark includes spongiform changes in the brain, development of abnormal protein aggregates, neuronal loss, markers of neuronal loss, rapidly progressing dementia, and death.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyribosyl sugar moiety, as found in naturally occurring deoxyribonucleic acids (DNA). In certain embodiments, a 2'-deoxynucleoside may comprise a modified nucleobase or may comprise an RNA nucleobase (uracil). Unless otherwise specified, a 2'-deoxynucleoside has the β-D configuration.

As used herein, "2'-substituted nucleoside" means a nucleoside comprising a 2'-substituted sugar moiety. As used herein, "2'-substituted" in reference to a sugar moiety means a sugar moiety comprising at least one 2-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is spongiform changes in the brain, development of abnormal protein aggregates, neuronal loss, markers of neuronal loss, rapidly progressing dementia, and death.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising cEt modified sugar.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-β-D-deoxyribosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "MOE" means methoxyethyl. "2'-MOE" or "2'-MOE modified sugar" means a 2'-OCH$_2$CH$_2$OCH$_3$ group in place of the 2'-OH group of a ribosyl sugar moiety.

As used herein, "2'-MOE nucleoside" means a nucleoside comprising a 2'-MOE modified sugar.

As used herein, "motif" means the pattern of unmodified and/or modified sugar moieties, nucleobases, and/or internucleoside linkages, in an oligonucleotide.

As used herein, "RNA" means an RNA transcript that encodes a protein and includes pre-mRNA and mature mRNA unless otherwise specified.

As used herein, "neurodegenerative disease" means a condition marked by progressive loss of function or structure, including loss of motor function and death of neurons. In certain embodiments, the neurodegenerative disease is a prion disease. In certain embodiments, the neurodegenerative disease is any of Creutzfeldt-Jakob disease (CJD), variant Creutzfeldt-Jakob Disease (vCJD), familial Creutzfeldt-Jakob Disease (fCJD), Gerstmann-Straussler-Scheinker syndrome, fatal familial insomnia, kuru, Alzheimer's disease, or Parkinson's disease.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal. Certain such carriers enable pharmaceutical compositions to be formulated as, for example, tablets, pills, dragees, capsules, liquids, gels, syrups, slurries, suspension and lozenges for the oral ingestion by a subject.

In certain embodiments, a pharmaceutically acceptable carrier or diluent is sterile water, sterile saline, sterile buffer solution or sterile artificial cerebrospinal fluid.

As used herein "pharmaceutically acceptable salts" means physiologically and pharmaceutically parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein "PrP$^C$" means the normal cellular form of PrP protein.

As used herein "PrP$^{Sc}$" means the protease-resistant, disease-causing form of PrP protein.

As used herein "prodrug" means a therapeutic agent in a form outside the body that is converted to a different form within an animal or cells thereof. Typically, conversion of a prodrug within the animal is facilitated by the action of an enzymes (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "siRNA" refers to a ribonucleic acid molecule having a duplex structure including two antiparallel and substantially complementary nucleic acid strands. The two strands forming the duplex structure may be different portions of one larger RNA molecule, or they may be separate RNA molecules. Where the two strands are part of one larger molecule, and therefore are connected by consecutive nucleobases between the 3'-end of one strand and the 5' end of the respective other strand forming the duplex structure, the connecting RNA chain is referred to as a "hairpin loop". The RNA strands may have the same or a different number of nucleotides.

As used herein, "standard cell assay" means the assay described in Example 1 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the results of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) deoxyribosyl moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

Certain Embodiments

The present disclosure provides the following non-limiting numbered embodiments:

Embodiment 1. An oligomeric compound comprising a modified oligonucleotide consisting of 12 to 30 linked nucleosides wherein the nucleobase sequence of the modified oligonucleotide is at least 90% complementary to an equal length portion of a PRNP nucleic acid, and wherein the modified oligonucleotide comprises at least one modification selected from a modified sugar, a sugar surrogate, and a modified internucleoside linkage.

Embodiment 2. An oligomeric compound comprising a modified oligonucleotide consisting of 12 to 30 linked nucleosides and having a nucleobase sequence comprising at least 12, 13, 14, 15, 16, 17, 18, 19, or 20 nucleobases of any of SEQ ID NOS: 27-2744.

Embodiment 3. An oligomeric compound comprising a modified oligonucleotide consisting of 12 to 30 linked nucleosides and having a nucleobase sequence comprising at least 12, 13, 14, 15, 16, 17, 18, or 19 nucleobases of any of SEQ ID NOS: 2745-2766.

Embodiment 4. An oligomeric compound comprising a modified oligonucleotide consisting of 12 to 30 linked nucleosides and having a nucleobase sequence comprising at least 12, 13, 14, 15, 16, 17, or 18 nucleobases of any of SEQ ID NOS: 2767-2780.

Embodiment 5. An oligomeric compound comprising a modified oligonucleotide consisting of 12 to 30 linked nucleosides and having a nucleobase sequence comprising at least 12, 13, 14, 15, 16, or 17 nucleobases of any of SEQ ID NOS: 2781-2802.

Embodiment 6. An oligomeric compound comprising a modified oligonucleotide consisting of 12 to 30 linked nucleosides and having a nucleobase sequence comprising at least 12, 13, 14, 15, or 16 nucleobases of any of SEQ ID NOS: 2803-2806.

Embodiment 7. An oligomeric compound comprising a modified oligonucleotide consisting of 12 to 30 linked nucleosides and having a nucleobase sequence comprising a portion of at least 8, at least 9, at least 10, at least 11, at least 12, at least 13, at least 14, at least 15, at least 16, at least 17, at least 18, at least 19, or at least 20 contiguous nucleobases, wherein the portion is complementary to:
an equal length portion of nucleobases 5,635-5,677 of SEQ ID NO: 2;
an equal length portion of nucleobases 5,791-5,826 of SEQ ID NO: 2; or
an equal length portion of nucleobases 14,366-14,410 of SEQ ID NO: 2.

Embodiment 8. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, or at least 18 contiguous nucleobases of a nucleobase sequence selected from:
SEQ ID Nos: 530, 607, 684, 761, 838, 915, 1914, 1992, 2069, 2146, 2237, 2301, 2302, 2536, 2640, 2750, 2759, 2760, 2764, 2788-2793, 2803-2806;
SEQ ID Nos: 1225, 1302, 1379, 1456, 2240, 2307, 2308, 2383, 2471, 2537, 2568, 2647, 2736-2739, 2798-2801; or
SEQ ID Nos: 555, 632, 709, 786, 863, 940, 1017, 1862, 1939, 2017, 2094, 2171, 2257, 2334, 2407, 2408, 2488, 2508, 2543, 2612, 2659, 2677, 2757, 2766, 2794-2797.

Embodiment 9. An oligomeric compound comprising a modified oligonucleotide consisting of 12 to 30 linked nucleosides and having a nucleobase sequence comprising a portion of at least 8, at least 9, at least 10, at least 11, at least 12, at least 13, at least 14, at least 15, at least 16, at least 17, at least 18, at least 19, or at least 20 contiguous nucleobases, wherein the portion is complementary to:
an equal length portion of nucleobases 4,902-4,929 of SEQ ID NO: 2;
an equal length portion of nucleobases 5,000-5,026 of SEQ ID NO: 2;
an equal length portion of nucleobases 5,073-5,100 of SEQ ID NO: 2;
an equal length portion of nucleobases 5,515-5,559 of SEQ ID NO: 2;
an equal length portion of nucleobases 5,595-5,632 of SEQ ID NO: 2;
an equal length portion of nucleobases 5,666-5,690 of SEQ ID NO: 2;
an equal length portion of nucleobases 5,857-5,881 of SEQ ID NO: 2;
an equal length portion of nucleobases 9,352-9,377 of SEQ ID NO: 2;
an equal length portion of nucleobases 11,331-11,358 of SEQ ID NO: 2;
an equal length portion of nucleobases 16,292-16,328 of SEQ ID NO: 2;
an equal length portion of nucleobases 17,120-17,151 of SEQ ID NO: 2;
an equal length portion of nucleobases 17,211-17,241 of SEQ ID NO: 2;
an equal length portion of nucleobases 17,281-17,331 of SEQ ID NO: 2;
an equal length portion of nucleobases 17,410-17,445 of SEQ ID NO: 2;
an equal length portion of nucleobases 17,601-17,641 of SEQ ID NO: 2;
an equal length portion of nucleobases 17,635-17,670 of SEQ ID NO: 2;
an equal length portion of nucleobases 17,663-17,712 of SEQ ID NO: 2;
an equal length portion of nucleobases 17,753-17,781 of SEQ ID NO: 2; or
an equal length portion of nucleobases 17,985-18,016 of SEQ ID NO: 2.

Embodiment 10. The oligomeric compound of any of embodiments 1-9, wherein the modified oligonucleotide has a nucleobase sequence that is at least 80%, 85%, 90%, 95%, or 100% complementary to the nucleobase sequences of SEQ ID NO: 1, SEQ ID NO: 2, SEQ ID NO: 3, or SEQ ID NO: 4 when measured across the entire nucleobase sequence of the modified oligonucleotide.

Embodiment 11. The oligomeric compound of any of embodiments 1-10, wherein the modified oligonucleotide comprises at least one modified nucleoside.

Embodiment 12. The oligomeric compound of embodiment 11, wherein the modified oligonucleotide comprises at least one modified nucleoside comprising a modified sugar moiety.

Embodiment 13. The oligomeric compound of embodiment 12, wherein the modified oligonucleotide comprises at least one modified nucleoside comprising a bicyclic sugar moiety.

Embodiment 14. The oligomeric compound of embodiment 13, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 15. The oligomeric compound of any of embodiments 11-14, wherein the modified oligonucleotide comprises at least one modified nucleoside comprising a non-bicyclic modified sugar moiety.

Embodiment 16. The oligomeric compound of embodiment 17, wherein the modified oligonucleotide comprises at least one modified nucleoside comprising a non-bicyclic modified sugar moiety comprising a 2'-MOE modified sugar or 2'-OMe modified sugar.

Embodiment 17. The oligomeric compound of any of embodiments 11-16, wherein the modified oligonucleotide comprises at least one modified nucleoside comprising a sugar surrogate.

Embodiment 18. The oligomeric compound of embodiment 15, wherein the modified oligonucleotide comprises at least one modified nucleoside comprising a sugar surrogate selected from morpholino and PNA.

Embodiment 19. The oligomeric compound of any of embodiments 1-12 or 15-18, wherein the modified oligonucleotide does not comprise a bicyclic sugar moiety.

Embodiment 20. The oligomeric compound of any of embodiments 1-19, wherein the modified oligonucleotide has a sugar motif comprising:
- a 5'-region consisting of 1-7 linked 5'-region nucleosides;
- a central region consisting of 6-10 linked central region nucleosides; and
- a 3'-region consisting of 1-7 linked 3'-region nucleosides; wherein
- each of the 5'-region nucleosides and each of the 3'-region nucleosides comprises a modified sugar and each of the central region nucleosides comprises a 2'-deoxyribosyl sugar.

Embodiment 21. The oligomeric compound of embodiment 20, wherein the modified oligonucleotide has
- a 5'-region consisting of 4 linked 5'-region nucleosides;
- a central region consisting of 8 linked central region nucleosides; and
- a 3'-region consisting of 4 linked 3'-region nucleosides; wherein
- each of the 5'-region nucleosides comprises a 2'-MOE modified sugar, each of the 3'-region nucleosides comprises either a 2'-MOE modified sugar or a cEt modified sugar, and each of the central region nucleosides comprises a 2'-deoxyribosyl sugar.

Embodiment 22. The oligomeric compound of embodiment 20, wherein the modified oligonucleotide has
- a 5'-region consisting of 4 linked 5'-region nucleosides;
- a central region consisting of 8 linked central region nucleosides; and
- a 3'-region consisting of 5 linked 3'-region nucleosides; wherein
- each of the 5'-region nucleosides comprises a 2'-MOE modified sugar, each of the 3'-region nucleosides comprises either a 2'-MOE modified sugar or a cEt modified sugar, and each of the central region nucleosides comprises a 2'-deoxyribosyl sugar.

Embodiment 23. The oligomeric compound of embodiment 20, wherein the modified oligonucleotide has
- a 5'-region consisting of 5 linked 5'-region nucleosides;
- a central region consisting of 8 linked central region nucleosides; and
- a 3'-region consisting of 5 linked 3'-region nucleosides; wherein
- each of the 5'-region and each of the 3'-region nucleosides comprises a 2'-MOE modified sugar, and each of the central region nucleosides comprises a 2'-deoxyribosyl sugar.

Embodiment 24. The oligomeric compound of embodiment 20, wherein the modified oligonucleotide has
- a 5'-region consisting of 5 linked 5'-region nucleosides;
- a central region consisting of 9 linked central region nucleosides; and
- a 3'-region consisting of 5 linked 3'-region nucleosides; wherein
- each of the 3'-region nucleosides comprises either a 2'-MOE modified sugar or a cEt modified sugar, and each of the central region nucleosides comprises a 2'-deoxyribosyl sugar.

Embodiment 25. The oligomeric compound of embodiment 20, wherein the modified oligonucleotide has
- a 5'-region consisting of 5 linked 5'-region nucleosides;
- a central region consisting of 9 linked central region nucleosides; and
- a 3'-region consisting of 5 linked 3'-region nucleosides; wherein
- each of the 5'-region nucleosides and each of the 3'-region nucleosides comprises a 2'-MOE modified sugar, and each of the central region nucleosides comprises a 2'-deoxyribosyl sugar.

Embodiment 26. The oligomeric compound of embodiment 20, wherein the modified oligonucleotide has a sugar motif comprising:
- a 5'-region consisting of 6 linked 5'-region nucleosides;
- a central region consisting of 10 linked central region nucleosides; and
- a 3'-region consisting of 4 linked 3'-region nucleosides; wherein
- each of the 5'-region nucleosides and each of the 3'-region nucleosides comprises a 2'-MOE modified sugar, and each of the central region nucleosides comprises a 2'-deoxyribosyl sugar.

Embodiment 27. The oligomeric compound of embodiment 20, wherein the modified oligonucleotide has a sugar motif comprising:
- a 5'-region consisting of 6 linked 5'-region nucleosides;
- a central region consisting of 10 linked central region nucleosides; and
- a 3'-region consisting of 4 linked 3'-region nucleosides; wherein
- each of the 3'-region nucleosides comprises either a 2'-MOE modified sugar or a cEt modified sugar, and each of the central region nucleosides comprises a 2'-deoxyribosyl sugar.

Embodiment 28. The oligomeric compound of embodiment 20, wherein the modified oligonucleotide has a sugar motif comprising:
- a 5'-region consisting of 5 linked 5'-region nucleosides;
- a central region consisting of 10 linked central region nucleosides; and
- a 3'-region consisting of 5 linked 3'-region nucleosides; wherein
- each of the 5'-region nucleosides and each of the 3'-region nucleosides comprises a 2'-MOE modified sugar, and each of the central region nucleosides comprises a 2'-deoxyribosyl sugar.

Embodiment 29. The oligomeric compound of embodiment 20, wherein the modified oligonucleotide has a sugar motif comprising:
- a 5'-region consisting of 5 linked 5'-region nucleosides;
- a central region consisting of 10 linked central region nucleosides; and
- a 3'-region consisting of 5 linked 3'-region nucleosides; wherein
- each of the 3'-region nucleosides comprises either a 2'-MOE modified sugar or a cEt modified sugar, and each of the central region nucleosides comprises a 2'-deoxyribosyl sugar.

Embodiment 30. The oligomeric compound of embodiment 20, wherein the modified oligonucleotide has a sugar motif comprising:
- a 5'-region consisting of 4 linked 5'-region nucleosides;
- a central region consisting of 10 linked central region nucleosides; and
- a 3'-region consisting of 6 linked 3'-region nucleosides; wherein
- each of the 5'-region nucleosides and each of the 3'-region nucleosides comprises a 2'-MOE modified sugar, and each of the central region nucleosides comprises a 2'-deoxyribosyl sugar.

Embodiment 31. The oligomeric compound of embodiment 20, wherein the modified oligonucleotide has
a 5'-region consisting of 3 linked 5'-region nucleosides;
a central region consisting of 10 linked central region nucleosides; and
a 3'-region consisting of 7 linked 3'-region nucleosides; wherein
each of the 5'-region nucleosides and each of the 3'-region nucleosides comprises a 2'-MOE modified sugar, and each of the central region nucleosides comprises a 2'-deoxyribosyl sugar.

Embodiment 32. The oligomeric compound of embodiment 20, wherein the modified oligonucleotide has
a 5'-region consisting of 7 linked 5'-region nucleosides;
a central region consisting of 10 linked central region nucleosides; and
a 3'-region consisting of 3 linked 3'-region nucleosides; wherein
each of the 5'-region nucleosides and each of the 3'-region nucleosides comprises a 2'-MOE modified sugar, and each of the central region nucleosides comprises a 2'-deoxyribosyl sugar.

Embodiment 33. The oligomeric compound of any of embodiments 20-32, wherein the 2'-deoxyribosyl sugar is a 2'-β-D-deoxyribosyl sugar.

Embodiment 34. The oligomeric compound of any of embodiments 1-19, wherein the modified oligonucleotide has a sugar motif comprising:
a 5'-region consisting of 1-6 linked 5'-region nucleosides;
a central region consisting of 6-10 linked central region nucleosides; and
a 3'-region consisting of 1-6 linked 3'-region nucleosides; wherein
each of the 5'-region nucleosides and each of the 3'-region nucleosides comprises a modified sugar, and the central region has the following formula:

(Nd)(Nx)(Nd)n wherein Nx is a 2'-OMe nucleoside and each Nd is a 2'-Q-D-deoxynucleoside; and n is from 6 to 8.

Embodiment 35. The oligomeric compound of embodiment 34, wherein the modified oligonucleotide has a sugar motif comprising:
a 5'-region consisting of 5 linked 5'-region nucleosides;
a central region consisting of 8 linked central region nucleosides; and
a 3'-region consisting of 5 linked 3'-region nucleosides; wherein
each of the 5'-region nucleosides and each of the 3'-region nucleosides comprises a 2'-MOE modified sugar,
and the central region has the following formula:

(Nd)(Nx)(Nd)n wherein Nx is a nucleoside comprising a 2'-OMe sugar and each Nd is a nucleoside comprising s a 2'-deoxyribosyl sugar;
and n is 6.

Embodiment 36. The oligomeric compound of embodiment 34, wherein the modified oligonucleotide has a sugar motif comprising:
a 5'-region consisting of 5 linked 5'-region nucleosides;
a central region consisting of 8 linked central region nucleosides; and
a 3'-region consisting of 5 linked 3'-region nucleosides; wherein
each of the 5'-region nucleosides and each of the 3'-region nucleosides comprises a 2'-MOE modified sugar,
and the central region has the following formula:

(Nd)(Nx)(Nd)n wherein Nx is a nucleoside comprising a 2'-OMe sugar and each Nd is a nucleoside comprising s a 2'-deoxyribosyl sugar;
and n is 6.

Embodiment 37. The oligomeric compound of embodiment 34, wherein the modified oligonucleotide has a sugar motif comprising:
a 5'-region consisting of 5 linked 5'-region nucleosides;
a central region consisting of 10 linked central region nucleosides; and
a 3'-region consisting of 5 linked 3'-region nucleosides; wherein
each of the 5'-region nucleosides and each of the 3'-region nucleosides comprises a 2'-MOE modified sugar,
and the central region has the following formula:

(Nd)(Nx)(Nd)n wherein Nx is a nucleoside comprising a 2'-OMe sugar and each Nd is a nucleoside comprising s a 2'-deoxyribosyl sugar;
and n is 8.

Embodiment 38. The oligomeric compound of any of embodiments 34-37, wherein the 2'-deoxyribosyl sugar is a 2'-β-D-deoxyribosyl sugar.

Embodiment 39. The oligomeric compound of any of embodiments 1-38, wherein the modified oligonucleotide comprises at least one modified internucleoside linkage.

Embodiment 40. The oligomeric compound of embodiment 39, wherein each internucleoside linkage of the modified oligonucleotide is a modified internucleoside linkage.

Embodiment 41. The oligomeric compound of embodiment 39 or 40 wherein at least one internucleoside linkage is a phosphorothioate internucleoside linkage.

Embodiment 42. The oligomeric compound of embodiment 39 or 41 wherein the modified oligonucleotide comprises at least one phosphodiester internucleoside linkage.

Embodiment 43. The oligomeric compound of any of embodiments 39, 41, or 42, wherein each internucleoside linkage is independently selected from a phosphodiester internucleoside linkage or a phosphorothioate internucleoside linkage.

Embodiment 44. The oligomeric compound of any of embodiments 1-43, wherein the modified oligonucleotide comprises at least one modified nucleobase.

Embodiment 45. The oligomeric compound of embodiment 44, wherein the modified nucleobase is a 5-methyl cytosine.

Embodiment 46. The oligomeric compound of any of embodiments 1-45, wherein the modified oligonucleotide consists of 12-30, 12-22, 12-20, 14-20, 15-25, 16-20, 18-22 or 18-20 linked nucleosides.

Embodiment 47. The oligomeric compound of any of embodiments 1-21, 33, 34, or 38-46 wherein the modified oligonucleotide consists of 16 linked nucleosides.

Embodiment 48. The oligomeric compound of any of embodiments 1-20, 22, 33, 34, or 38-46 wherein the modified oligonucleotide consists of 17 linked nucleosides.

Embodiment 49. The oligomeric compound of any of embodiments 1-20, 23, 33, 34-36 or 38-46 wherein the modified oligonucleotide consists of 18 linked nucleosides.

Embodiment 50. The oligomeric compound of any of embodiments 1-20, 24, 25, 33, 34, or 38-46 wherein the modified oligonucleotide consists of 19 linked nucleosides.

Embodiment 51. The oligomeric compound of any of embodiments 1-20, 26-34, or 37-46, wherein the modified oligonucleotide consists of 20 linked nucleosides.

Embodiment 52. The oligomeric compound of embodiment 39, wherein the modified oligonucleotide has the internucleoside linkage motif soosssssssssooooss, sooooosssssssssooss, sooooosssssssssssooss, sooooosssssssssOss, ssoooosssssssssssOs, soooooosssssssssoos, soooossssssssssooss, sooossssssss-sooss, sooossssssssssoss, or soossssssssssoos wherein "s" represents a phosphoothioate internucleoside linkage and "o" represents a phosphodiester internucleoside linkage.

Embodiment 53. The oligomeric compound of any of embodiments 1-52, consisting of the modified oligonucleotide.

Embodiment 54. The oligomeric compound of any of embodiments 1-52, comprising a conjugate group comprising a conjugate moiety and a conjugate linker.

Embodiment 55. The oligomeric compound of embodiment 54, wherein the conjugate group comprises a GalNAc cluster comprising 1-3 GalNAc ligands.

Embodiment 56. The oligomeric compound of embodiments 54 or 55, wherein the conjugate linker consists of a single bond.

Embodiment 57. The oligomeric compound of embodiment 54, wherein the conjugate linker is cleavable.

Embodiment 58. The oligomeric compound of embodiment 54, wherein the conjugate linker comprises 1-3 linker-nucleosides.

Embodiment 59. The oligomeric compound of any of embodiments 54-58, wherein the conjugate group is attached to the modified oligonucleotide at the 5'-end of the modified oligonucleotide.

Embodiment 60. The oligomeric compound of any of embodiments 54-58, wherein the conjugate group is attached to the modified oligonucleotide at the 3'-end of the modified oligonucleotide.

Embodiment 61. The oligomeric compound of any of embodiments 1-60 comprising a terminal group.

Embodiment 62. The oligomeric compound of any of embodiments 1-61 wherein the oligomeric compound is a singled-stranded oligomeric compound.

Embodiment 63. The oligomeric compound of any of embodiments 1-57 or 59-62, wherein the oligomeric compound does not comprise linker-nucleosides.

Embodiment 64. An oligomeric duplex comprising an oligomeric compound of any of embodiments 1-61 or 63.

Embodiment 65. An antisense compound comprising or consisting of an oligomeric compound of any of embodiments 1-63 or an oligomeric duplex of embodiment 64.

Embodiment 66. A pharmaceutical composition comprising an oligomeric compound of any of embodiments 1-63 or an oligomeric duplex of embodiment 64 and a pharmaceutically acceptable carrier or diluent.

Embodiment 67. The pharmaceutical composition of embodiment 66, comprising a pharmaceutically acceptable diluent, wherein the pharmaceutically acceptable diluent is phosphate-buffered saline or artificial cerebrospinal fluid.

Embodiment 68. The pharmaceutical composition of embodiment 67, wherein the pharmaceutical composition consists essentially of the modified oligonucleotide and phosphate-buffered saline or artificial cerebrospinal fluid.

Embodiment 69. A method comprising administering to an animal a pharmaceutical composition of any of embodiments 66-68.

Embodiment 70. A method of treating a disease associated with PRNP comprising administering to an individual having or at risk for developing a disease associated with PRNP a therapeutically effective amount of a pharmaceutical composition according to any of embodiments 66-68; and thereby treating the disease associated with PRNP.

Embodiment 71. A method of reducing PrP protein in the CSF of an individual having or at risk for developing a disease associated with PRNP a therapeutically effective amount of a pharmaceutical composition according any of embodiments 66-68; and thereby reducing PrP protein in the CSF.

Embodiment 72. The method of embodiment 71, wherein the PrP protein is PrP$^C$.

Embodiment 73. The method of embodiment 71, wherein the PrP protein is PrP$^{Sc}$.

Embodiment 74. The method of embodiment 71, wherein the PrP protein is both PrP$^C$ and PrP$^{Sc}$.

Embodiment 75. The method of embodiment 70 or 71, wherein the administering is by intrathecal administration.

Embodiment 76. The method of embodiment 70 or embodiment 71, wherein the disease associated with PRNP is a neurodegenerative disease.

Embodiment 77. The method of embodiment 76, wherein the neurodegenerative disease is selected from among prion diseases, Creutzfeldt-Jakob disease (CJD), variant Creutzfeldt-Jakob Disease (vCJD), familial Creutzfeldt-Jakob Disease (fCJD), Gerstmann-Straussler-Scheinker syndrome, fatal familial insomnia, kuru, Alzheimer's disease, or Parkinson's disease.

Embodiment 78. The method of any of embodiments 70-77, wherein at least one symptom or hallmark of the neurodegenerative disease is ameliorated.

Embodiment 79. The method of embodiment 78, wherein the symptom or hallmark is any of spongiform changes in the brain, development of abnormal protein aggregates, neuronal loss, markers of neuronal loss, rapidly progressing dementia, or death.

Embodiment 80. A method of reducing PRNP RNA in a cell comprising contacting the cell with an oligomeric compound according to any of embodiments 1-63, an oligomeric duplex according to embodiment 64, or an antisense compound according to embodiment 65; and thereby reducing PRNP RNA in the cell.

Embodiment 81. A method of reducing PrP protein in a cell comprising contacting the cell with an oligomeric compound according to any of embodiments 1-63, an oligomeric duplex according to embodiment 64, or an antisense compound according to embodiment 65; and thereby reducing PrP in the cell.

Embodiment 82. The method of embodiment 81, wherein the PrP protein is PrP$^C$.

Embodiment 83. The method of embodiment 81, wherein the PrP protein is PrP$^{Sc}$ Embodiment 84. The method of embodiment 81, wherein the PrP protein is both PrP$^C$ and PrP$^{Sc}$ Embodiment 85. The method of any of embodiments 80-84, wherein the cell is in an animal.

Embodiment 86. A modified oligonucleotide according to the following chemical structure:
(SEQ ID NO: 1914)
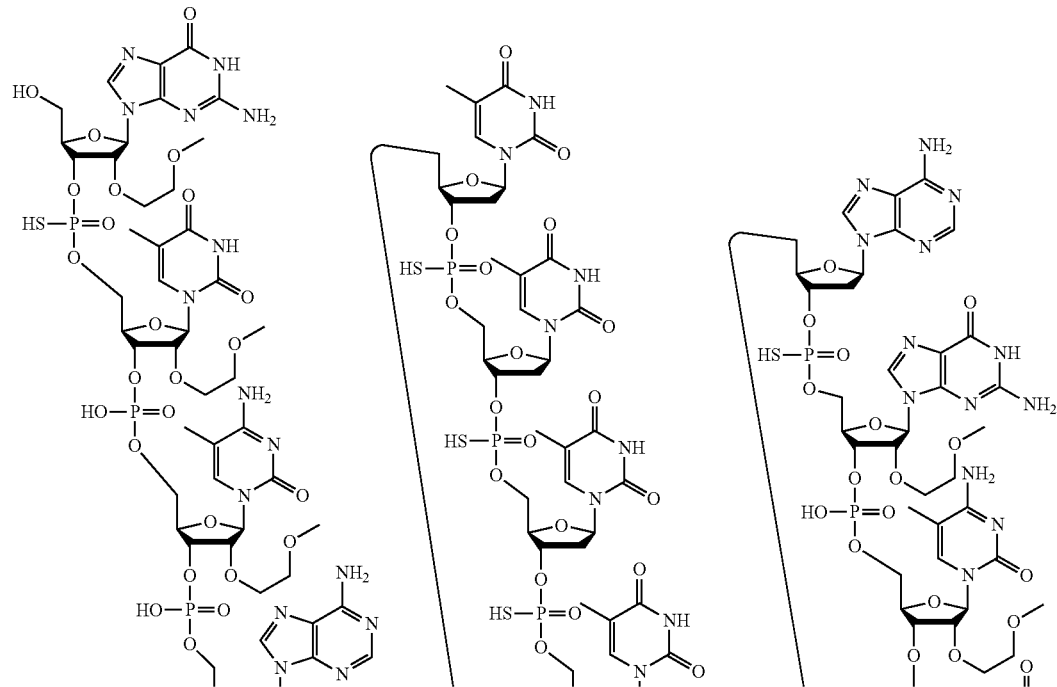
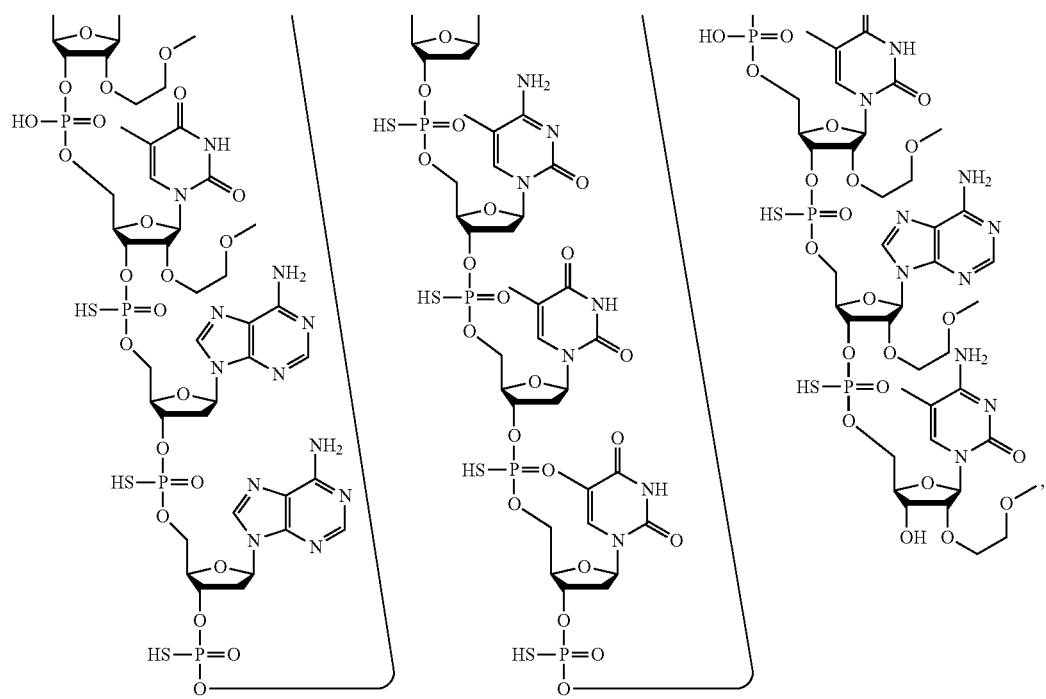
or a salt thereof.

Embodiment 87. A modified oligonucleotide according to the following chemical structure:
(SEQ ID NO: 1914)
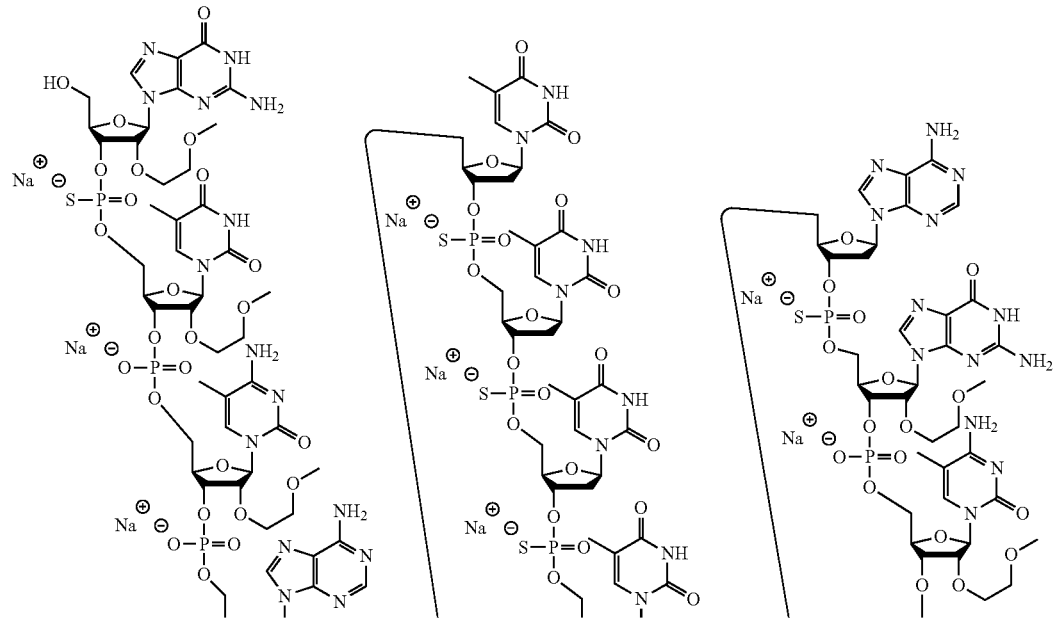
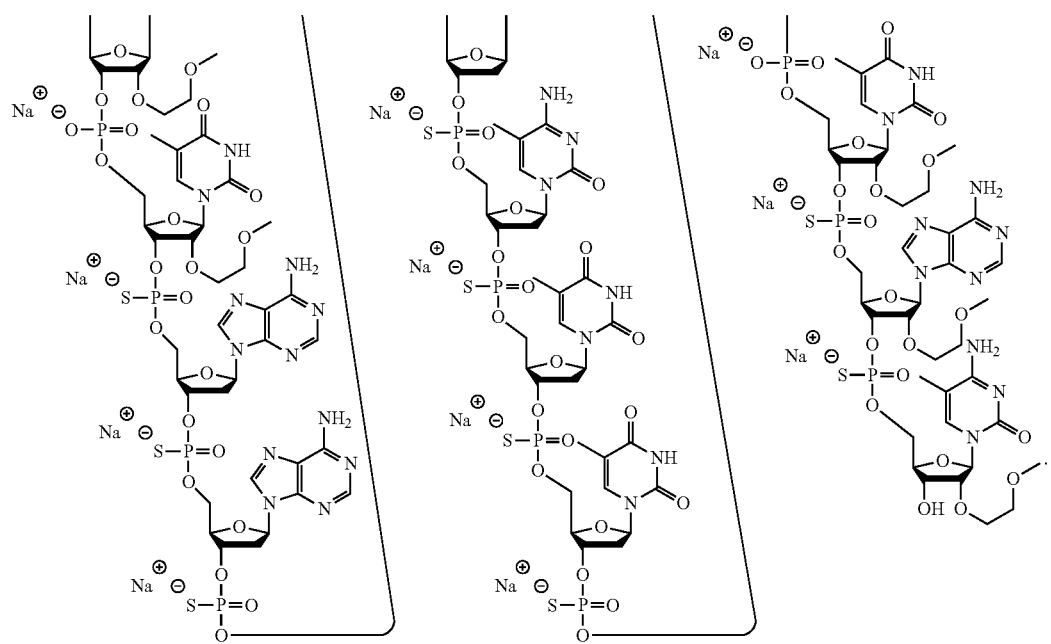

Embodiment 88. A modified oligonucleotide according to the following chemical structure:
(SEQ ID NO: 1914)
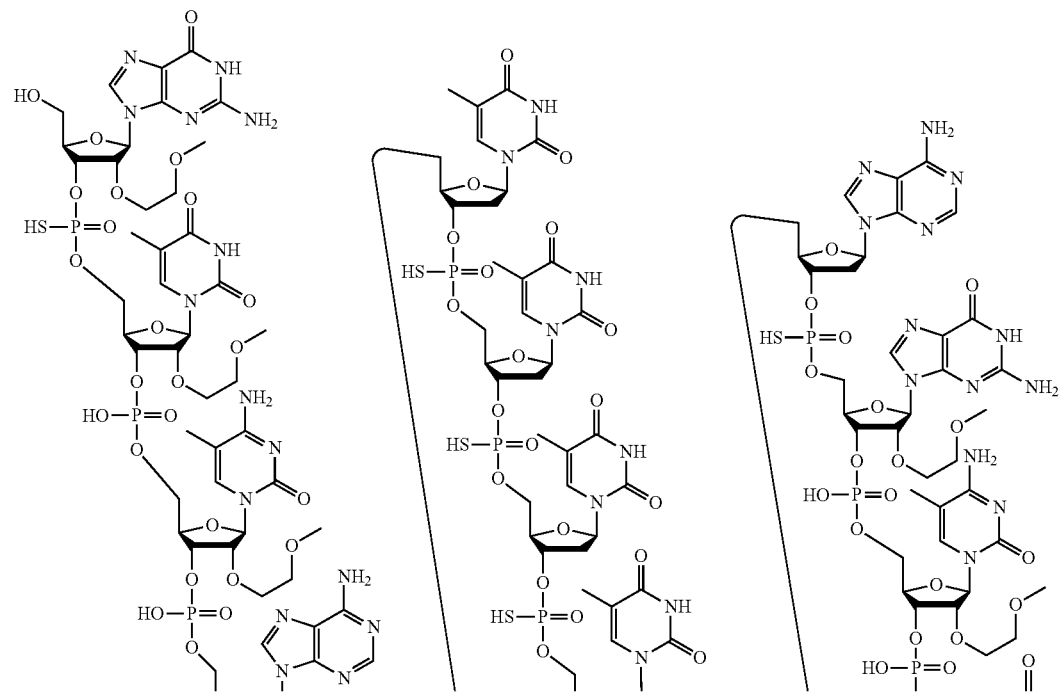
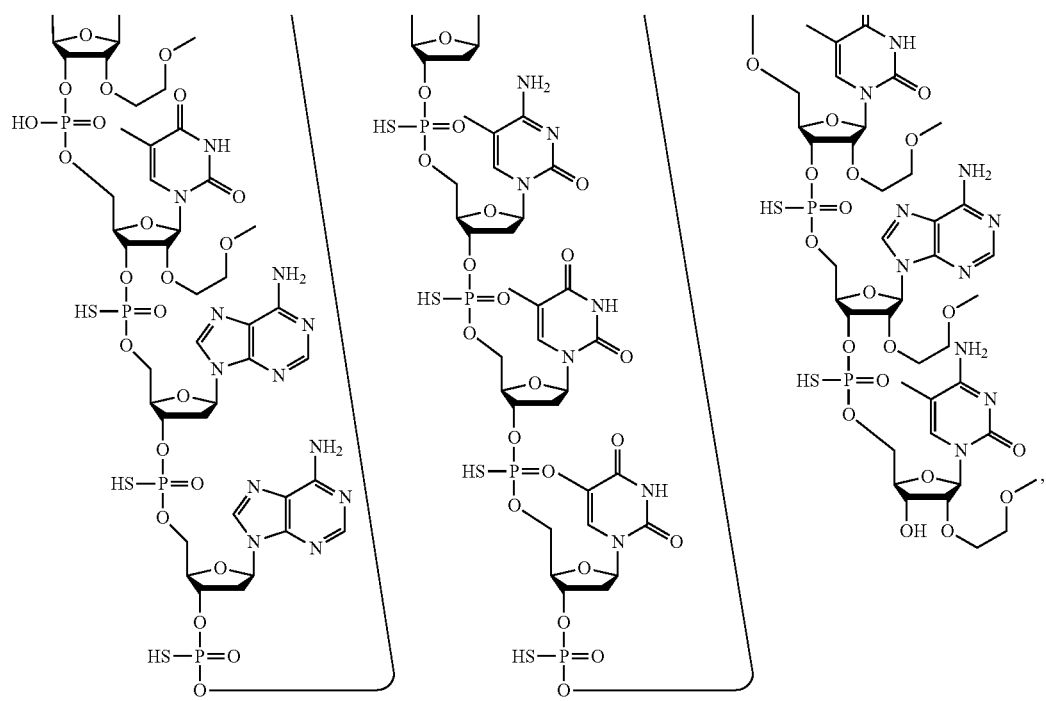
or a salt thereof.

Embodiment 89. A modified oligonucleotide according to the following chemical structure:
(SEQ ID NO: 1914)
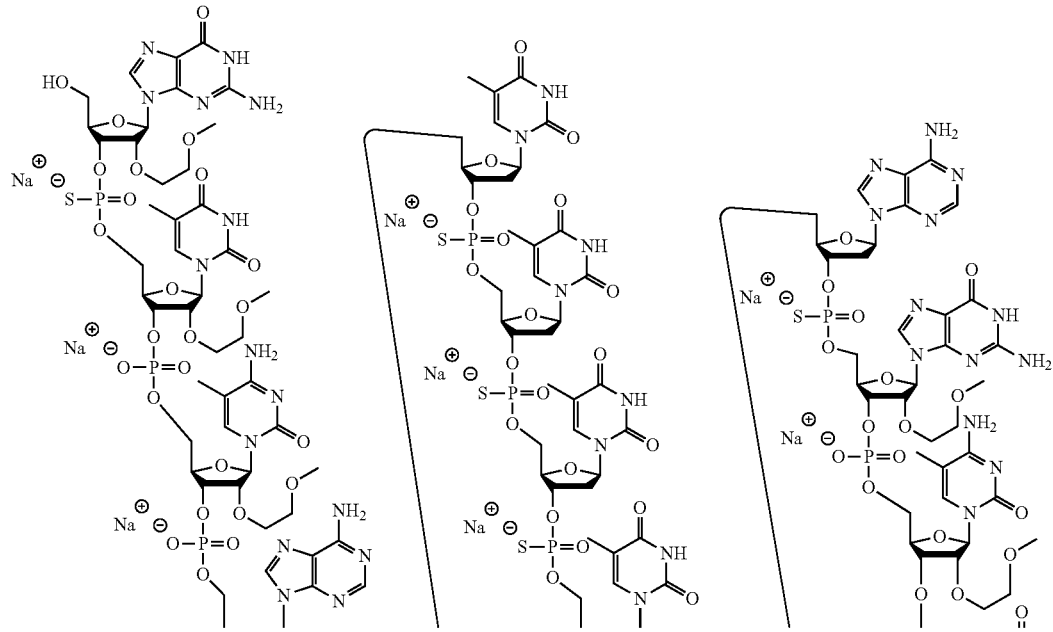
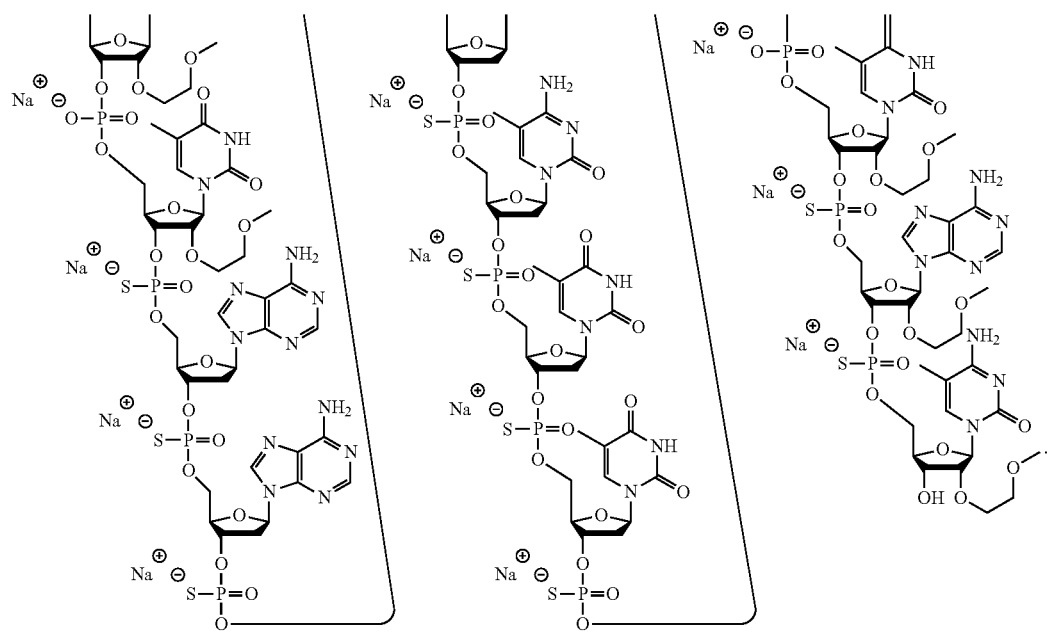

Embodiment 90. A modified oligonucleotide according to the following chemical structure:
(SEQ ID NO: 1939)
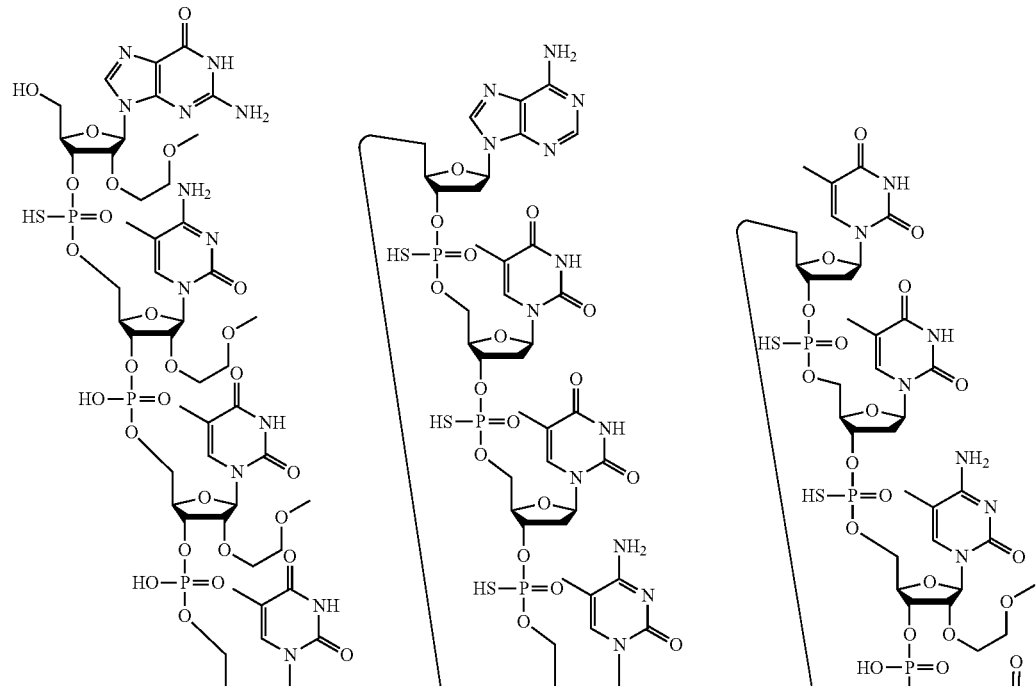
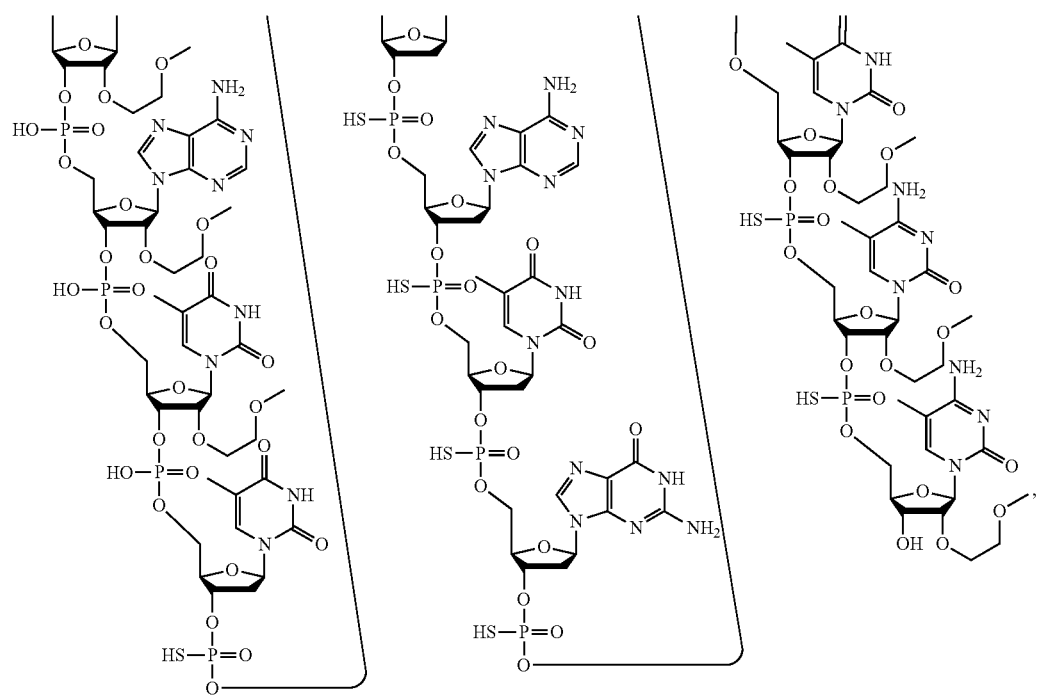
or a salt thereof.

Embodiment 91. A modified oligonucleotide according to the following chemical structure:
(SEQ ID NO: 1939)
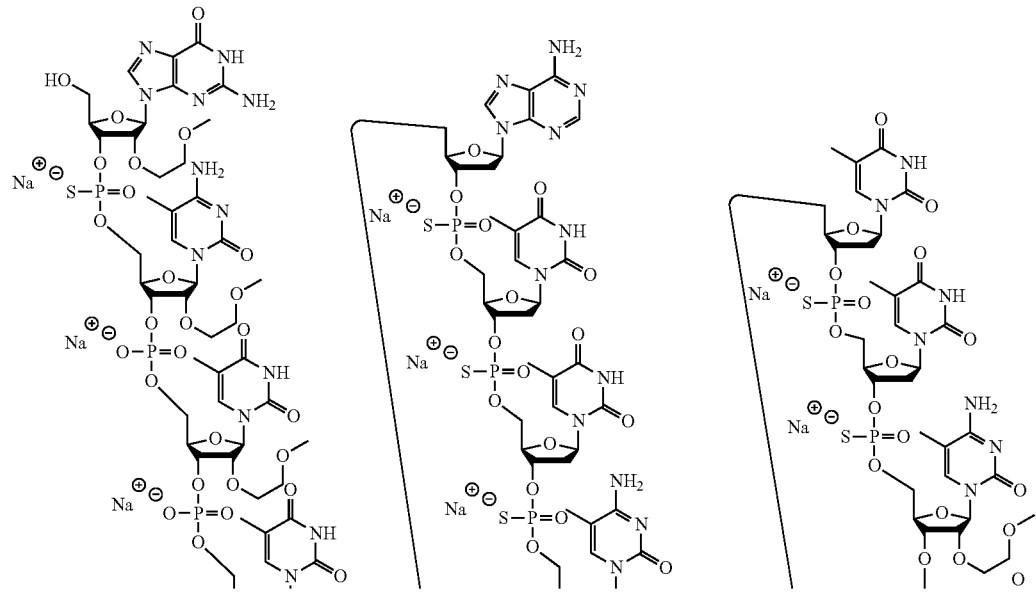
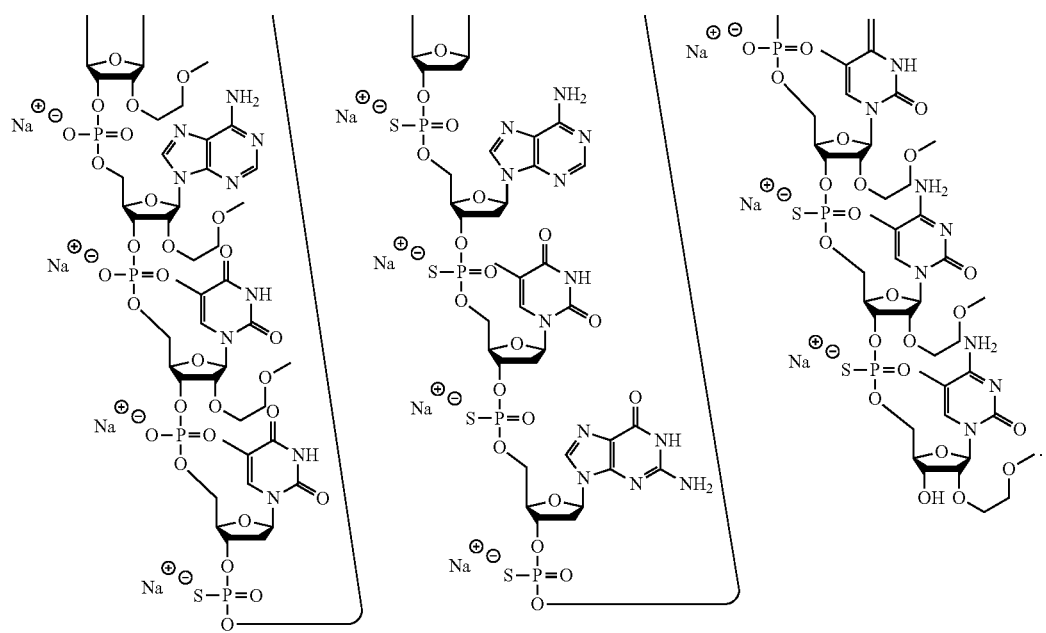

Embodiment 92. A modified oligonucleotide according to the following chemical structure:
(SEQ ID NO: 2302)
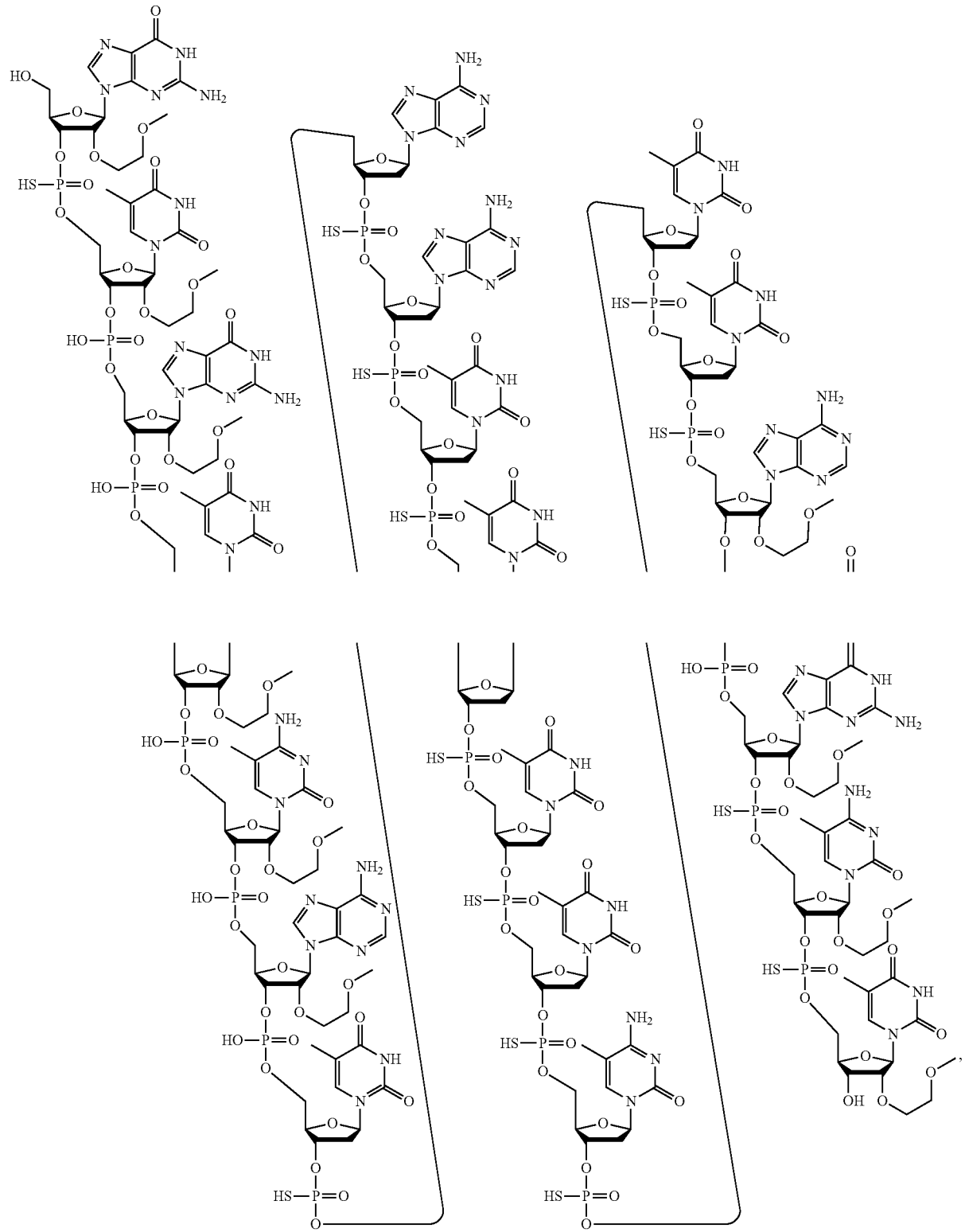
or a salt thereof.

Embodiment 93. A modified oligonucleotide according to the following chemical structure:
(SEQ ID NO: 2302)
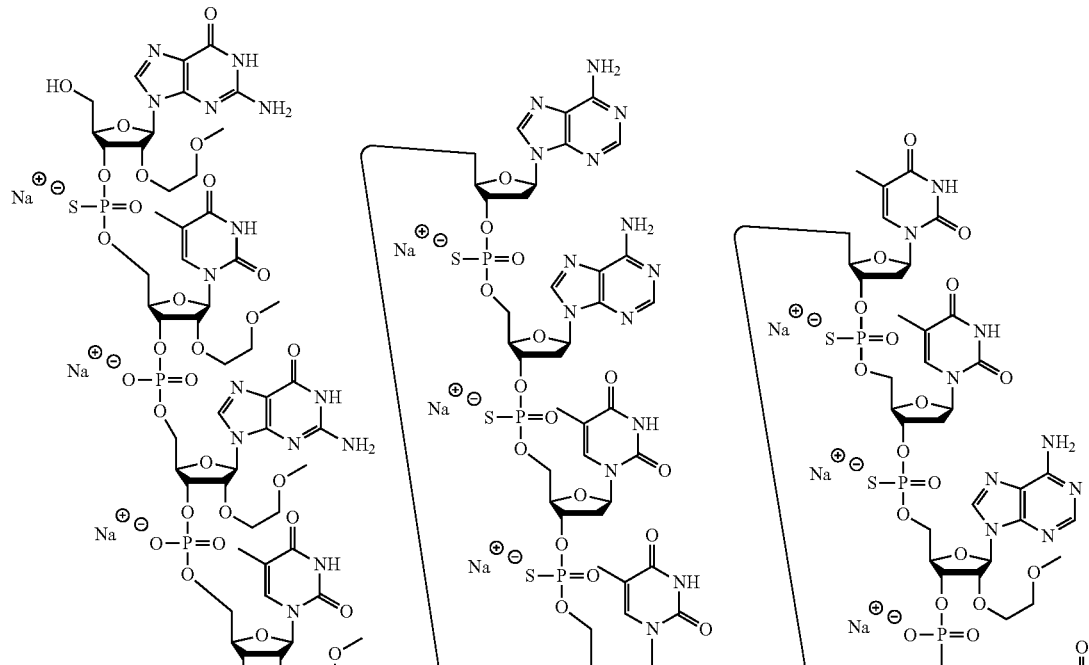
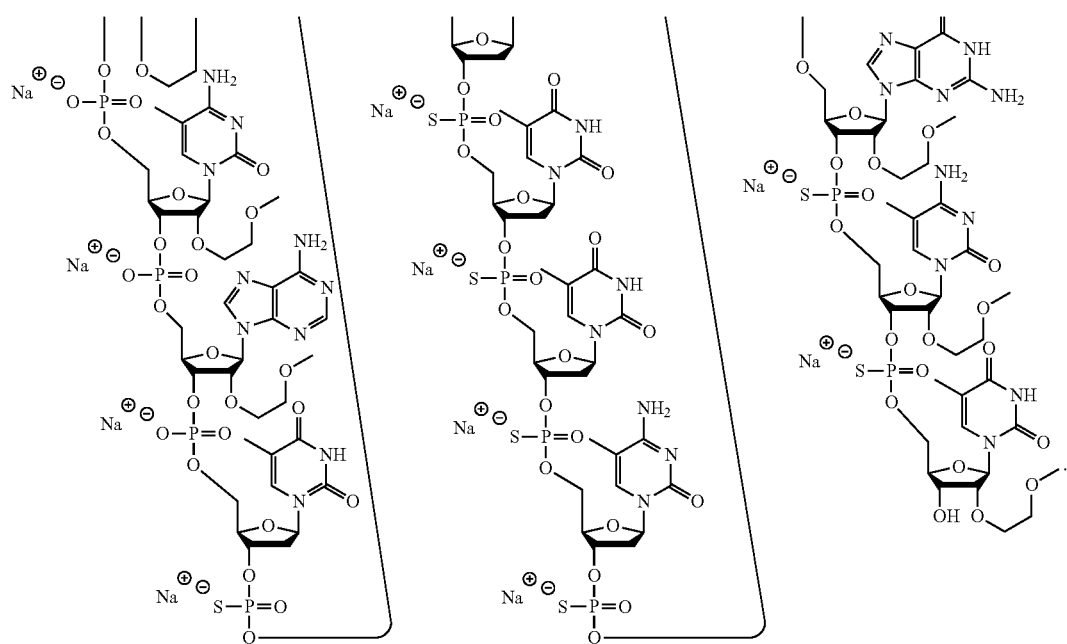

Embodiment 94. A modified oligonucleotide according to the following chemical structure:
(SEQ ID NO: 2750)
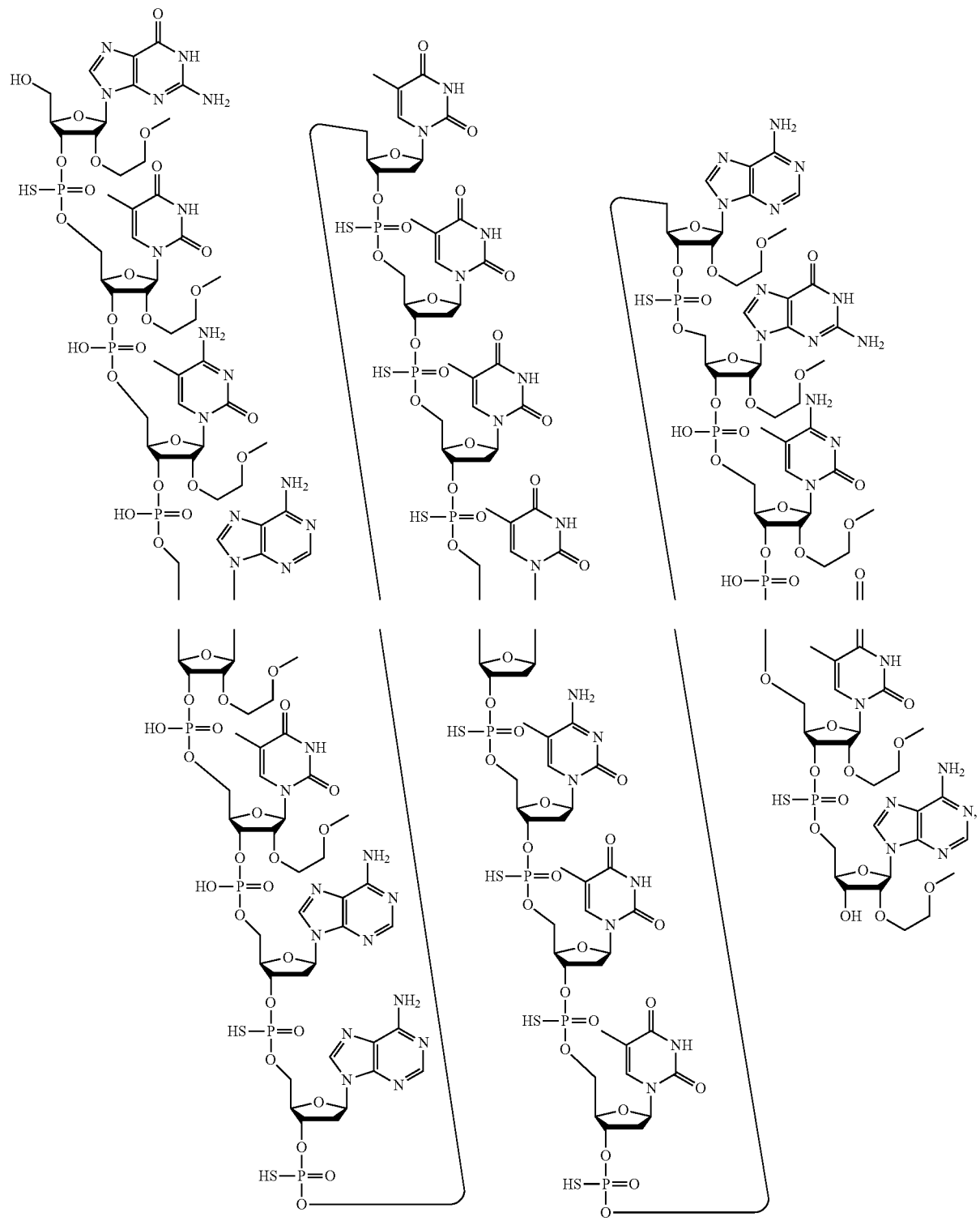
or a salt thereof.

Embodiment 95. A modified oligonucleotide according to the following chemical structure:
(SEQ ID NO: 2750)
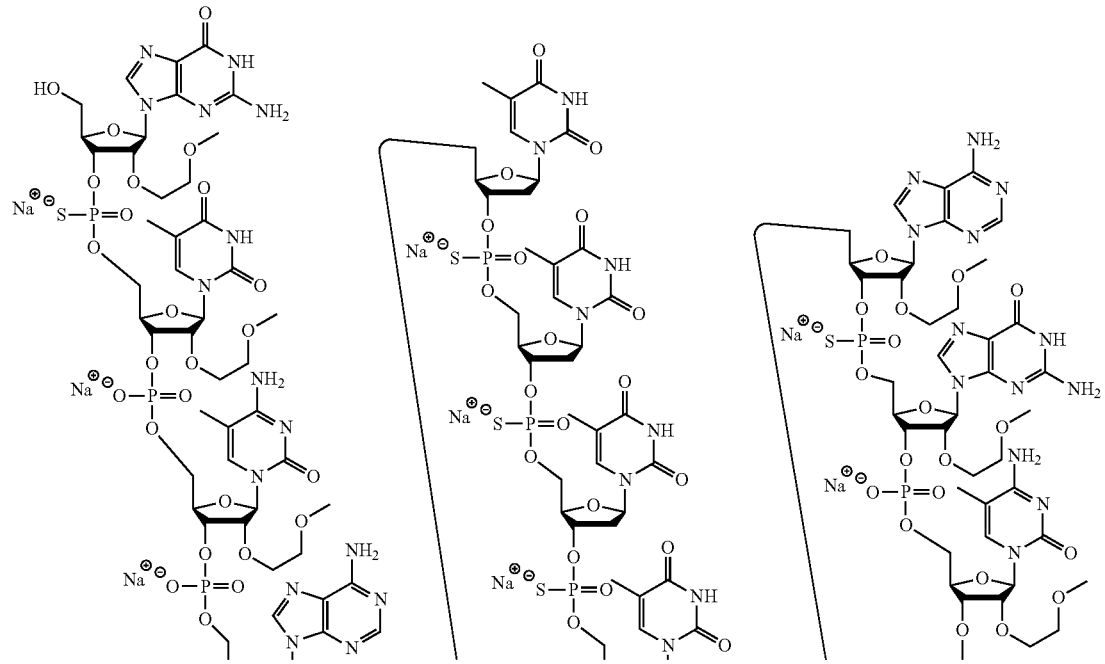
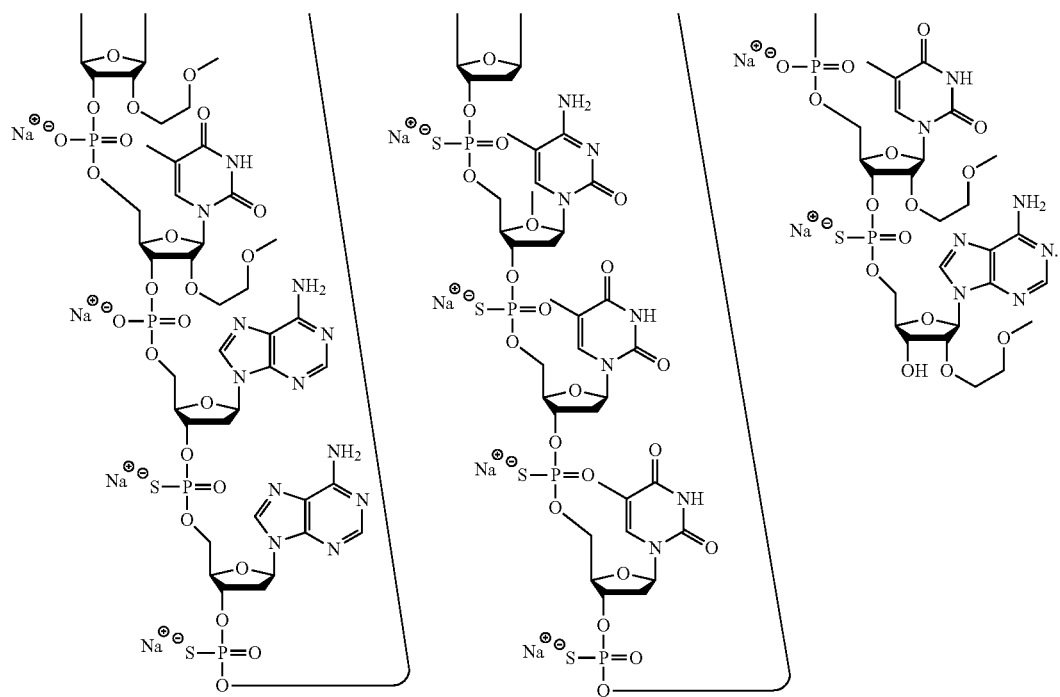

Embodiment 96. A modified oligonucleotide according to the following chemical structure:
(SEQ ID NO: 2739)
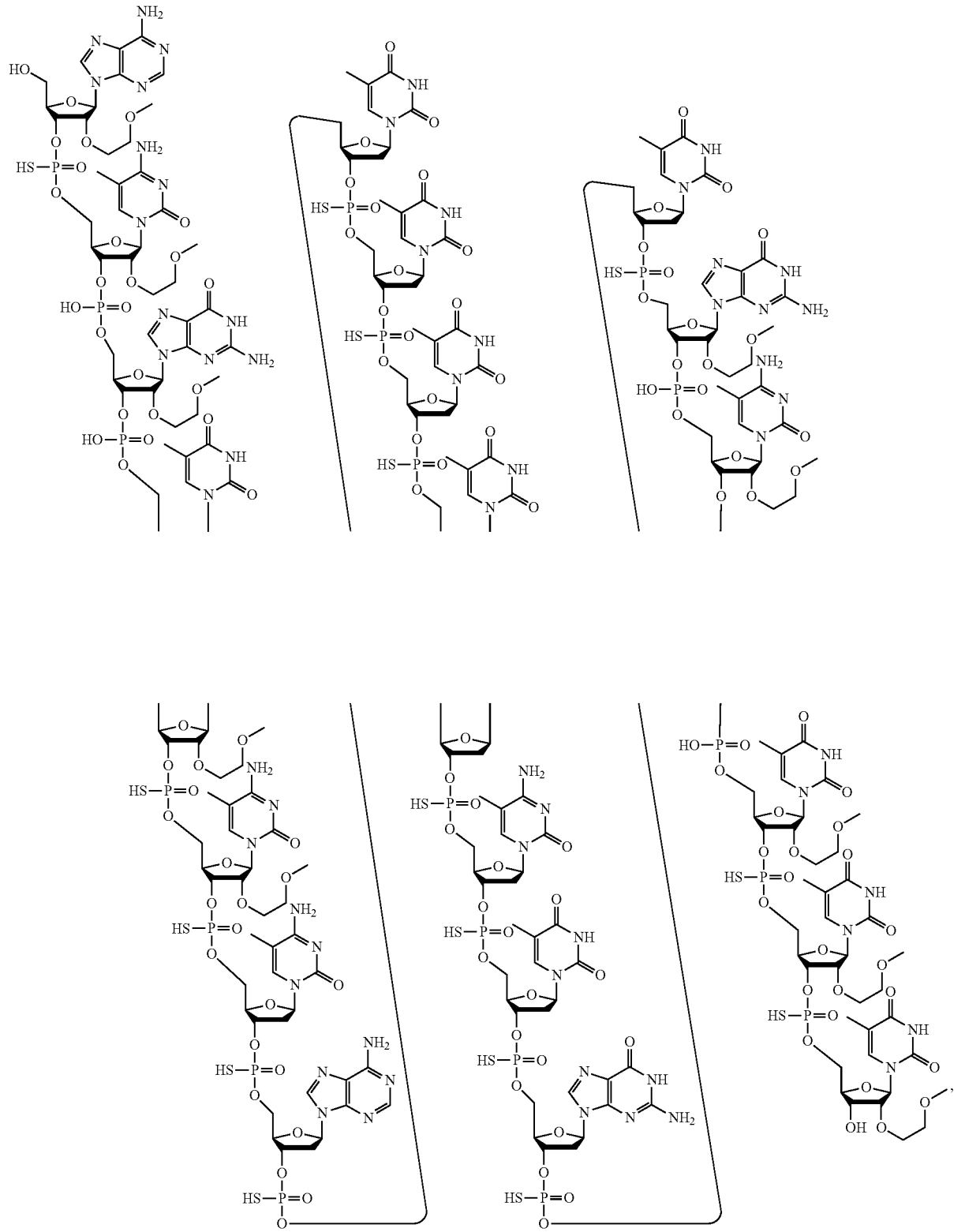
or a salt thereof.

Embodiment 97. A modified oligonucleotide according to the following chemical structure:
(SEQ ID NO: 2739)
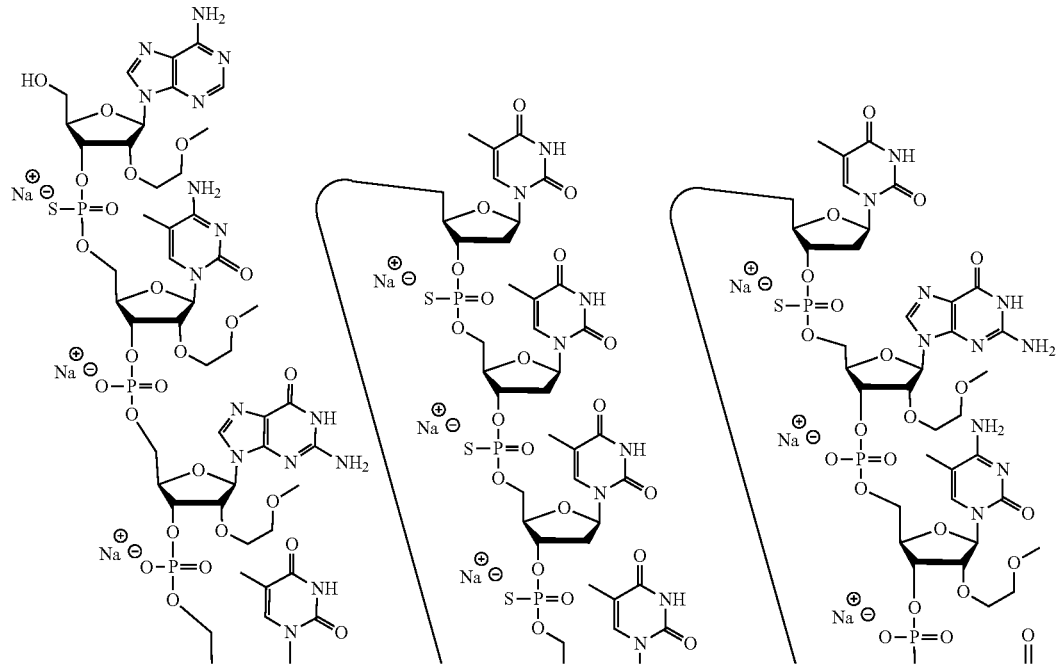
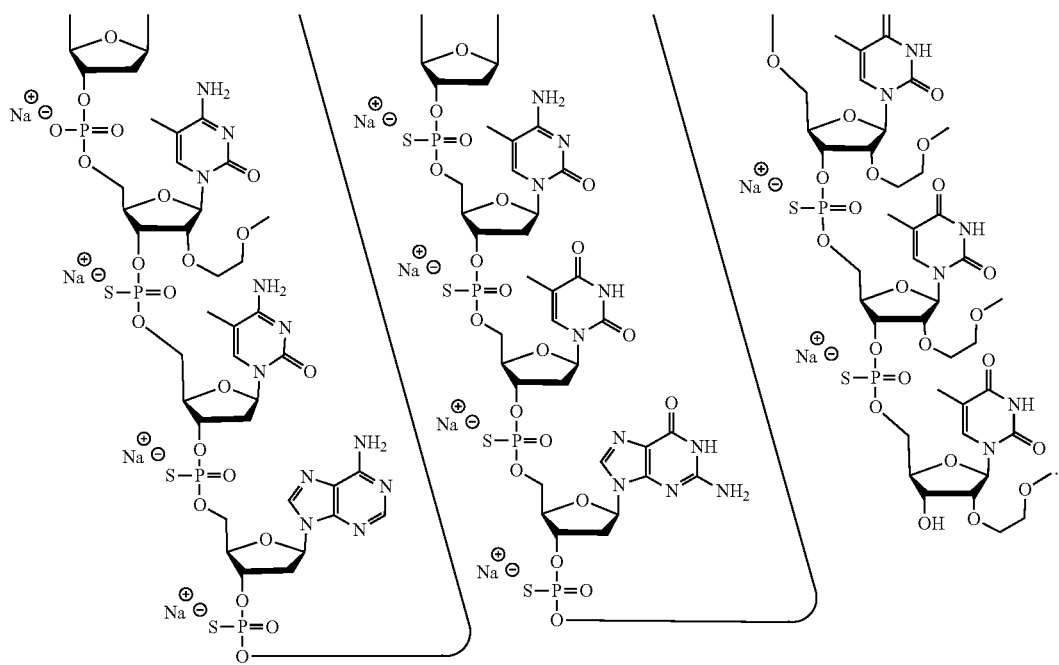

Embodiment 98. The modified oligonucleotide of embodiment 86, 88, 90, 92, 94, or 96 which is a sodium salt of the chemical structure.

Embodiment 99. A compound comprising a modified oligonucleotide according to the following chemical notation: Ges Teo $^m$Ceo Aeo Tes Ads Ads Tds Tds Tds Tds $^m$Cds Tds Tds Ads Geo $^m$Ceo Tes Aes $^m$Ce (SEQ ID NO: 1914), wherein,
A=an adenine nucleobase,
$^m$C=a 5-methyl cytosine nucleobase,
G=a guanine nucleobase,
T=a thymine nucleobase,
e=a 2'-MOE modified sugar,
d=a 2'-β-D deoxyribosyl sugar,
s=a phosphorothioate internucleoside linkage, and
o=a phosphodiester internucleoside linkage.

Embodiment 100. A compound comprising a modified oligonucleotide according to the following chemical notation: Ges Teo $^m$Ceo Aeo Teo Aeo Ads Tds Tds Tds Tds $^m$Cds Tds Tds Ads Gds $^m$Ceo Tes Aes $^m$Ce (SEQ ID NO: 1914), wherein,
A=an adenine nucleobase,
$^m$C=a 5-methyl cytosine nucleobase,
G=a guanine nucleobase,
T=a thymine nucleobase,
c=a 2'-MOE modified sugar,
d=a 2'-β-D deoxyribosyl sugar,
s=a phosphorothioate internucleoside linkage, and
o=a phosphodiester internucleoside linkage.

Embodiment 101. A compound comprising a modified oligonucleotide according to the following chemical notation: Ges $^m$Ceo Teo Teo Aeo Teo Tds Ads Tds Tds $^m$Cds Ads Tds Gds Tds Tds $^m$Ceo Tes $^m$Ces $^m$Ce (SEQ ID NO: 1939), wherein,
A=an adenine nucleobase,
$^m$C=a 5-methyl cytosine nucleobase,
G=a guanine nucleobase,
T=a thymine nucleobase,
e=a 2'-MOE modified sugar,
d=a 2'-β-D deoxyribosyl sugar,
s=a phosphorothioate internucleoside linkage, and
o=a phosphodiester internucleoside linkage.

Embodiment 102. A compound comprising a modified oligonucleotide according to the following chemical notation: Ges Teo Geo Teo $^m$Ceo Aeo Tds Ads Ads Tds Tds Tds Tds $^m$Cds Tds Tds Aeo Ges $^m$Ces Te (SEQ ID NO: 2302), wherein,
A=an adenine nucleobase,
mC=a 5-methyl cytosine nucleobase,
G=a guanine nucleobase,
T=a thymine nucleobase,
e=a 2'-MOE modified sugar,
d=a 2'-β-D deoxyribosyl sugar,
s=a phosphorothioate internucleoside linkage, and
o=a phosphodiester internucleoside linkage.

Embodiment 103. A compound comprising a modified oligonucleotide according to the following chemical notation: Ges Teo mCeo Aeo Teo Ads Ads Tds Tds Tds Tds mCds Tds Tds Aes Geo mCeo Tes Ae (SEQ ID NO: 2750), wherein,
A=an adenine nucleobase,
mC=a 5-methyl cytosine nucleobase,
G=a guanine nucleobase,
T=a thymine nucleobase,
e=a 2'-MOE modified sugar,
d=a 2'-β-D deoxyribosyl sugar,
s=a phosphorothioate internucleoside linkage, and
o=a phosphodiester internucleoside linkage.

Embodiment 104. A compound comprising a modified oligonucleotide according to the following chemical notation: Aes mCeo Geo Teo mCes mCds Ads Tds Tds Tds Tds mCds Tds Gds Tds Geo mCeo Tes Tes Te (SEQ ID NO: 2739), wherein,
A=an adenine nucleobase,
mC=a 5-methyl cytosine nucleobase,
G=a guanine nucleobase,
T=a thymine nucleobase,
c=a 2'-MOE modified sugar,
d=a 2'-β-D deoxyribosyl sugar,
s=a phosphorothioate internucleoside linkage, and
o=a phosphodiester internucleoside linkage.

Embodiment 105. The compound of any of embodiments 99-104, comprising the modified oligonucleotide covalently linked to a conjugate group.

Embodiment 106. A chirally enriched population of modified oligonucleotides of any of embodiments 86-105, wherein the population is enriched for modified oligonucleotides comprising at least one particular phosphorothioate internucleoside linkage having a particular stereochemical configuration.

Embodiment 107. The chirally enriched population of embodiment 106, wherein the population is enriched for modified oligonucleotides comprising at least one particular phosphorothioate internucleoside linkage having the (Sp) or (Rp) configuration.

Embodiment 108. The chirally enriched population of embodiment 106, wherein the population is enriched for modified oligonucleotides having a particular, independently selected stereochemical configuration at each phosphorothioate internucleoside linkage Embodiment 109. The chirally enriched population of embodiment 106, wherein the population is enriched for modified oligonucleotides having the (Sp) or (Rp) configuration at each phosphorothioate internucleoside linkage.

Embodiment 110. The chirally enriched population of embodiment 106, wherein the population is enriched for modified oligonucleotides having the (Rp) configuration at one particular phosphorothioate internucleoside linkage and the (Sp) configuration at each of the remaining phosphorothioate internucleoside linkages.

Embodiment 111. The chirally enriched population of embodiment 106 or embodiment 108 wherein the population is enriched for modified oligonucleotides having at least 3 contiguous phosphorothioate internucleoside linkages in the Sp, Sp, and Rp configurations, in the 5' to 3' direction.

Embodiment 112. A population of modified oligonucleotides of any of embodiments 86-105, wherein all of the phosphorothioate internucleoside linkages of the modified oligonucleotide are stereorandom. Embodiment 113. A pharmaceutical composition comprising the population of modified oligonucleotides of any of embodiments 106-112 and a pharmaceutically acceptable carrier or diluent.

Embodiment 114. A pharmaceutical composition of any of embodiments 86-105, and a pharmaceutically acceptable diluent or carrier.

Embodiment 115. The pharmaceutical composition of embodiment 114, comprising a pharmaceutically acceptable diluent, wherein the pharmaceutically acceptable diluent is phosphate-buffered saline or artificial cerebrospinal fluid.

Embodiment 116. The pharmaceutical composition of embodiment 115, wherein the pharmaceutical composition consists essentially of the modified oligonucleotide and phosphate-buffered saline or artificial cerebrospinal fluid.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)- alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836).

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2 furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt"), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O- 2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Alback et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J Org. Chem.*, 1998, 63, 10035-10039; Srivastava et al., *J. Am. Chem. Soc.*, 20017, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

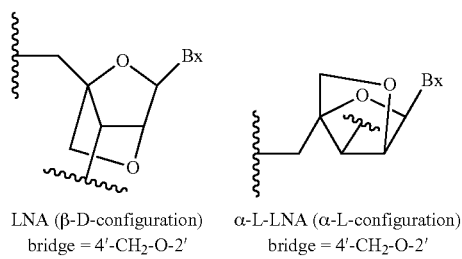

LNA (β-D-configuration)
bridge = 4'-CH$_2$-O-2'

α-L-LNA (α-L-configuration)
bridge = 4'-CH$_2$-O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

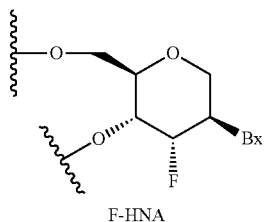

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

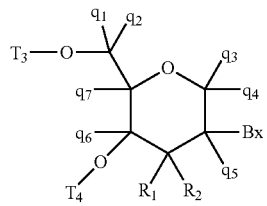

wherein, independently, for each of said modified THP nucleoside:
Bx is a nucleobase moiety;
T$_3$ and T$_4$ are each, independently, an internucleoside linking group linking the modified THP nucleoside to the remainder of an oligonucleotide or one of T$_3$ and T$_4$ is an internucleoside linking group linking the modified THP nucleoside to the remainder of an oligonucleotide and the other of T$_3$ and T$_4$ is H, a hydroxyl protecting group, a linked conjugate group, or a 5' or 3'-terminal group;
q$_1$, q$_2$, q$_3$, q$_4$, q$_5$, q$_6$ and q$_7$ are each, independently, H, C$_1$-C$_6$ alkyl, substituted C$_1$-C$_6$ alkyl, C$_2$-C$_6$ alkenyl, substituted C$_2$-C$_6$ alkenyl, C$_2$-C$_6$ alkynyl, or substituted C$_2$-C$_6$ alkynyl; and
each of R$_1$ and R$_2$ is independently selected from among: hydrogen, halogen, substituted or unsubstituted alkoxy, NJ$_1$J$_2$, SJ$_1$, N$_3$, OC(=X)J$_1$, OC(=X)NJ$_1$J$_2$, NJ$_3$C(=X)NJ$_1$J$_2$, and CN, wherein X is O, S or NJ$_1$, and each J$_1$, J$_2$, and J$_3$ is, independently, H or C$_1$-C$_6$ alkyl.

In certain embodiments, modified THP nucleosides are provided wherein q$_1$, q$_2$, q$_3$, q$_4$, q$_5$, q$_6$ and q$_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

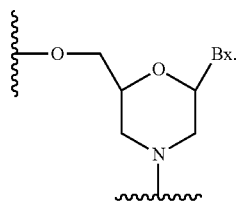

In certain embodiments, morpholinos may be modified, for example by adding or altering various substituent groups from the above morpholino structure. Such sugar surrogates are referred to herein as "modified morpholinos." In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoyleytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deazaadenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P═O") (also referred to as unmodified or naturally occurring linkages), phosphotriesters, methylphosphonates, phosphoramidates, and phosphorothioates ("P═S"), and phosphorodithioates ("HS—P═S"). Representative non-phosphorus containing internucleoside linking groups include but are not limited to methylenemethylimino (—CH$_2$—N(CH$_3$)—O—CH$_2$—), thiodiester, thionocarbamate (—O—C(═O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., JACS 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

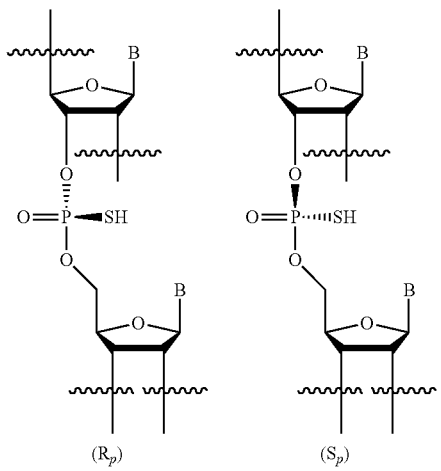

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—N($CH_3$)—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl, and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 6 or 7 nucleosides. In certain embodiments, each nucleoside of each wing of a gapmer is a modified nucleoside. In certain embodiments, at least one nucleoside of each wing of a gapmer is a modified nucleoside. In certain embodiments, at least two nucleosides of each wing of a gapmer are modified nucleosides. In certain embodiments, at least three nucleosides of each wing of a gapmer are modified nucleosides. In certain embodiments, at least four nucleosides of each wing of a gapmer are modified nucleosides.

In certain embodiments, the gap of a gapmer comprises 7-12 nucleosides. In certain embodiments, each nucleoside of the gap of a gapmer is an unmodified 2'-deoxynucleoside. In certain embodiments, at least one nucleoside of the gap of a gapmer is a modified nucleoside. In certain embodiments, at least one nucleoside of the gap of a gapmer comprises a 2'-deoxyfuranosyl sugar moiety that has an isomeric configuration other than the (i-D-ribosyl configuration.

In certain embodiments, the gapmer is a deoxy gapmer. In certain embodiments, the nucleosides on the gap side of each wing/gap junction are unmodified 2'-deoxynucleosides and the nucleosides on the wing sides of each wing/gap junction are modified nucleosides. In certain embodiments, each nucleoside of the gap is an unmodified 2'-deoxynucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar of each wing and the gap nucleosides comprise unmodified deoxynucleosides. Thus, a 5-10-5 MOE gapmer consists of 5 linked 2'-MOE modified nucleosides in the 5'-wing, 10 linked deoxynucleosides in the gap, and 5 linked 2'-MOE nucleosides in the 3'-wing. In certain such embodiments, the deoxynucleosides in the gap comprise a 2'-β-D-deoxyribosyl sugar. A mixed wing gapmer has at least two different modified sugars in the 5' and/or 3' wing.

In certain embodiments, modified oligonucleotides are 5-10-5 MOE gapmers. In certain embodiments, modified oligonucleotides are 4-10-6 MOE gapmers. In certain embodiments, modified oligonucleotides are 6-10-4 MOE gapmers. In certain embodiments, modified oligonucleotides are 3-10-7 MOE gapmers. In certain embodiments, modified oligonucleotides are 7-10-3 MOE gapmers. In certain embodiments, modified oligonucleotides are 5-8-5 MOE gapmers. In certain embodiments, modified oligonucleotides are 5-9-5 MOE gapmers. In certain embodiments, modified oligonucleotides are X—Y—Z MOE gapmers, wherein X and Z are independently selected from 1, 2, 3, 4, 5, 6, or 7 linked 2'-MOE nucleosides and Y is selected from 7, 8, 9, 10, or 11 linked deoxynucleosides.

In certain embodiments, modified oligonucleotides have a sugar motif selected from the following (5' to 3'): eeeedddddddddddkkeee, eeeeedddddddddddkkee, eeeeeddddddddddkkeee, eeeedddddddddkkeee, eeeedddddddddkkee, eeeeedyddddddddeeeee, eeeeedydddddddeeeee, or eeeeeedyddddddddeeee, wherein 'd' represents a 2'-deoxyribosyl sugar moiety, 'e' represents a 2'-MOE sugar moiety, 'k' represents a cEt sugar moiety, and 'y' represents a 2'-OMe sugar moiety.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., Bioorg. Med. Chem. Lett., 1994, 4, 1053-1060), a thioether, e.g., hexyl-S-tritylthiol (Manoharan et al., Ann. N. Y. Acad. Sci., 1992, 660, 306-309; Manoharan et al., Bioorg. Med. Chem. Lett., 1993, 3, 2765-2770), a thiocholesterol (Oberhauser et al., Nucl. Acids Res., 1992, 20, 533-538), an aliphatic chain, e.g., do-decan-diol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid a palmityl moiety (Mishra et al., Biochim. Biophys. Acta, 1995, 1264, 229-237), an octadecylamine or hexylamino-carbonyl-oxycholesterol moiety (Crooke et al., J. Pharmacol. Exp. Ther., 1996, 277, 923-937), a tocopherol group (Nishina et al., Molecular Therapy Nucleic Acids, 2015, 4, e220; and Nishina et al., Molecular Therapy, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phosphate.

Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or animal.

V. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. PRNP

In certain embodiments, oligomeric compounds comprise or consist of an oligonucleotide comprising a region that is complementary to a target nucleic acid, wherein the target nucleic acid is PRNP. In certain embodiments, PRNP nucleic acid has the sequence set forth in SEQ ID NO: I (GENBANK Accession No: NM_000311.4) or SEQ ID NO: 2 (GENBANK Accession No: NC_000020.11 truncated from nucleotides 4683001 to 4705000). In certain embodiments, PRNP nucleic acid has the sequence set forth in SEQ ID NO: 3 (GENBANK Accession No.: NM_001080123.2), which is a splicing variant of SEQ ID NO: 1. In certain embodiments, PRNP nucleic acid has the sequence set forth in SEQ ID NO: 4 (ENSEMBL Accession No. ENST00000359125.6 from ENSEMBL version 98: September 2019, human reference assembly version GRCh38.p13 located on the reverse strand of chromosome 20 (CM000682.2) from positions 63,406, 137 to U.S. Pat. No. 63,472,590; Yates, et al., "Ensembl 2020", Nucleic Acids Research, gkz966, 2019), which is a splicing variant of SEQ ID NO: 1.

In certain embodiments, contacting a cell with an oligomeric compound complementary to SEQ ID NO: 1, SEQ ID NO: 2, SEQ ID NO: 3, or SEQ ID NO: 4 reduces the amount of PRNP RNA, and in certain embodiments reduces the amount of PrP protein. In certain embodiments, the oligomeric compound consists of a modified oligonucleotide. In certain embodiments, contacting a cell with an oligomeric compound complementary to SEQ ID NO: 1, SEQ ID NO: 2, SEQ ID NO: 3, or SEQ ID NO: 4 ameliorates one or more symptom or hallmark of a neurodegenerative disease. In certain embodiments, the oligomeric compound consists of a modified oligonucleotide. In certain embodiments, the symptom or hallmark is spongiform changes in the brain, development of abnormal protein aggregates, neuronal loss, markers of neuronal loss, rapidly progressing dementia, and death. In certain embodiments, the oligomeric compound consists of a modified oligonucleotide.

In certain embodiments, administration of an oligomeric compound complementary to SEQ ID NO: 1, SEQ ID NO: 2, SEQ ID NO: 3, or SEQ ID NO: 4 reduces the detectable amount of PrP protein in the CSF. In certain embodiments, the PrP protein is $PrP^C$. In certain embodiments, the PrP protein is $PrP^{Sc}$. In certain embodiments, the PrP protein is $PrP^C$ and $PrP^{Sc}$.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such tissues include brain tissues, such as, cortex, substantia nigra, striatum, midbrain, and brainstem and spinal cord.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

VII. Certain Compositions

1. Compound No. 1238994

In certain embodiments, Compound No. 1238994 is characterized as a 5-10-5 MOE gapmer having a sequence of (from 5' to 3') GTCATAATTTTCTTAGCTAC (SEQ ID NO: 1914), wherein each of nucleosides 1-5 and 16-20 (from 5' to 3') are 2'-MOE nucleosides and each of nucleosides 6-15 are 2'-R-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1238994 is represented by the following chemical notation (5' to 3'): Ges Teo $^m$Ceo Aeo Tes Ads Ads Tds Tds Tds Tds $^m$Cds Tds Tds Ads Geo $^m$Ceo Tes Aes $^m$Ce (SEQ ID NO: 1914), wherein, A=an adenine nucleobase,
$^m$C=a 5-methyl cytosine nucleobase,
G=a guanine nucleobase,
T=a thymine nucleobase,
e=a 2'-MOE modified sugar,
d=a 2'-β-D-deoxyribosyl sugar,
s=a phosphorothioate internucleoside linkage, and
o=a phosphodiester internucleoside linkage.

In certain embodiments, Compound No. 1238994 is represented by the following chemical structure:
(SEQ ID NO: 1914)
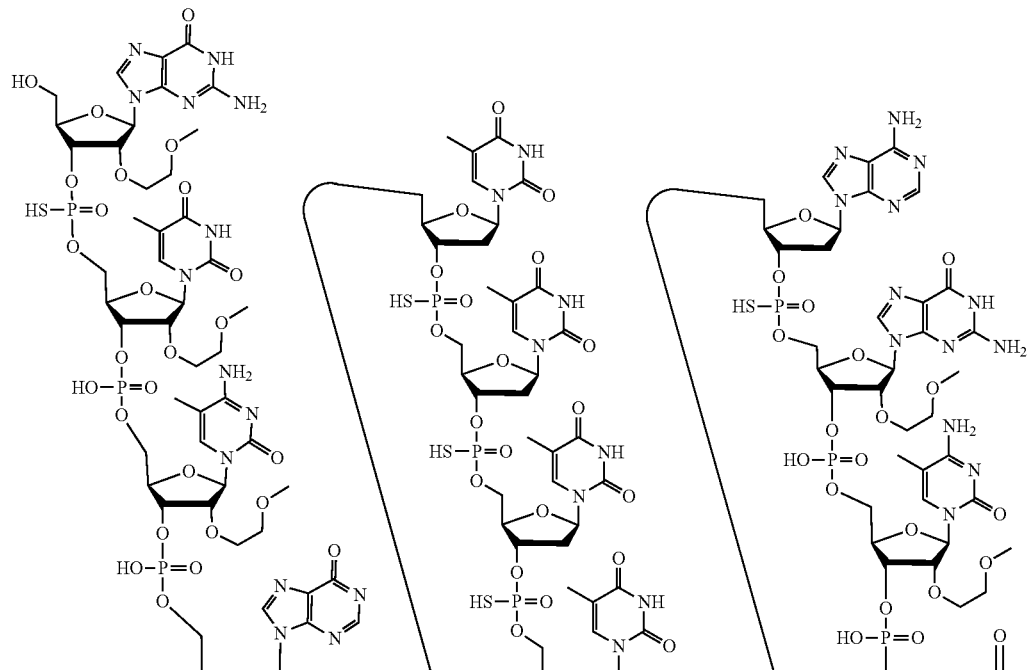
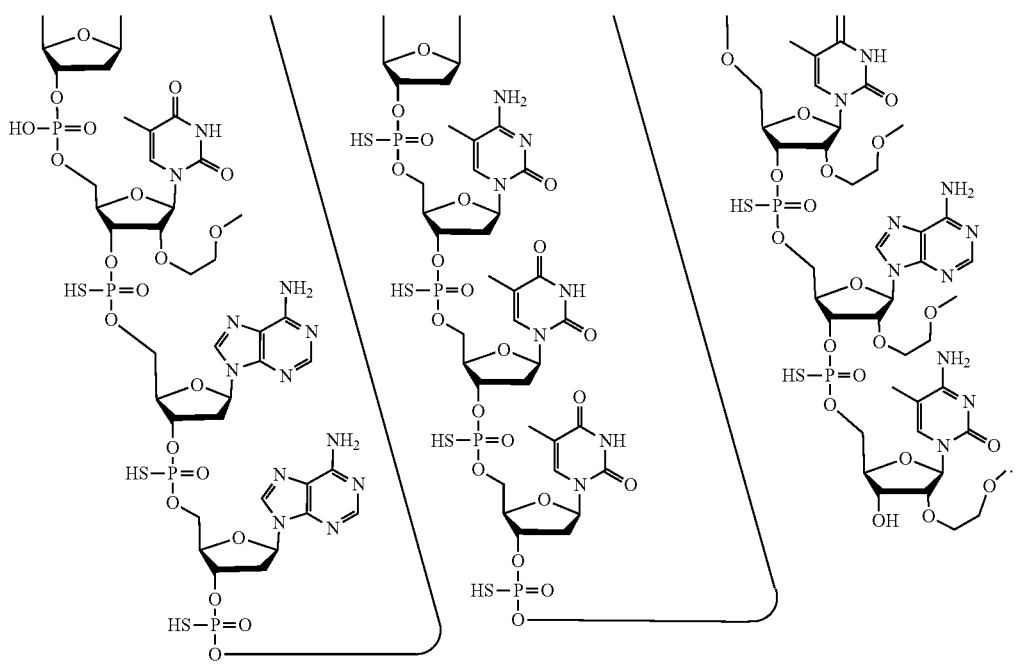

Structure 1. Compound No. 1238994

In certain embodiments, the sodium salt of Compound No. 1238994 is represented by the following chemical structure:

(SEQ ID NO: 1914)

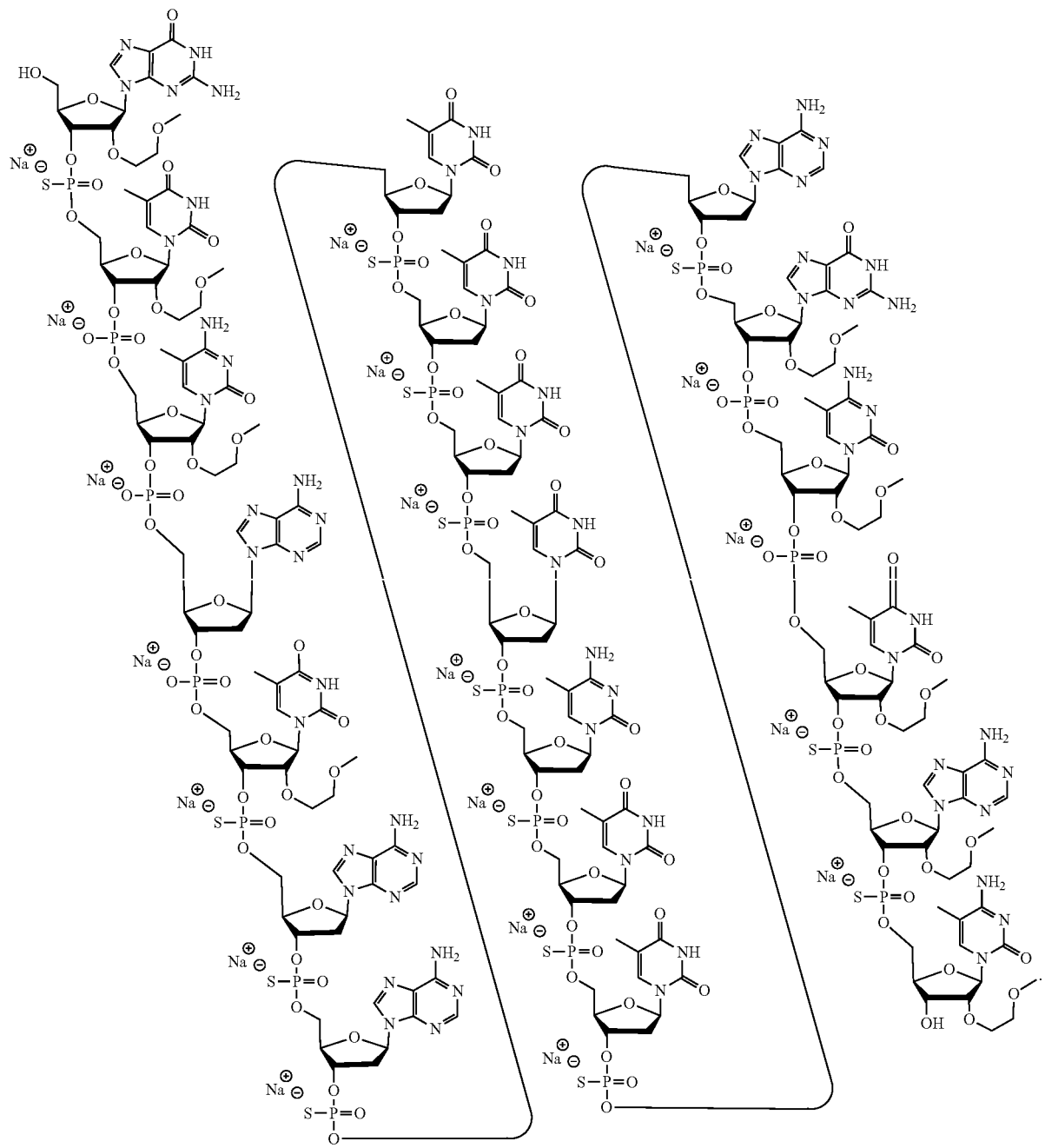

Structure 2. The Sodium Salt of Compound No. 1238994

2. Compound No. 1373021

In certain embodiments, Compound No. 1373021 is characterized as a 6-10-4 MOE gapmer having a sequence of (from 5' to 3') GTCATAATTTTCTTAGCTAC (SEQ ID NO: 1914), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7 and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1373021 is represented by the following chemical notation (5' to 3'): Ges Teo $^m$Ceo Aeo Teo Aeo Ads Tds Tds Tds Tds $^m$Cds Tds Tds Ads Gds $^m$Ceo Tes Aes $^m$Ce (SEQ ID NO: 1914), wherein,
A=an adenine nucleobase,
$^m$C a 5-methyl cytosine nucleobase,
G=a guanine nucleobase,
T=a thymine nucleobase,
e=a 2'-MOE modified sugar,
d=a 2'-β-D deoxyribosyl sugar,
s=a phosphorothioate internucleoside linkage, and
o=a phosphodiester internucleoside linkage.

In certain embodiments, Compound No. 1373021 is represented by the following chemical structure:

(SEQ ID NO: 1914)

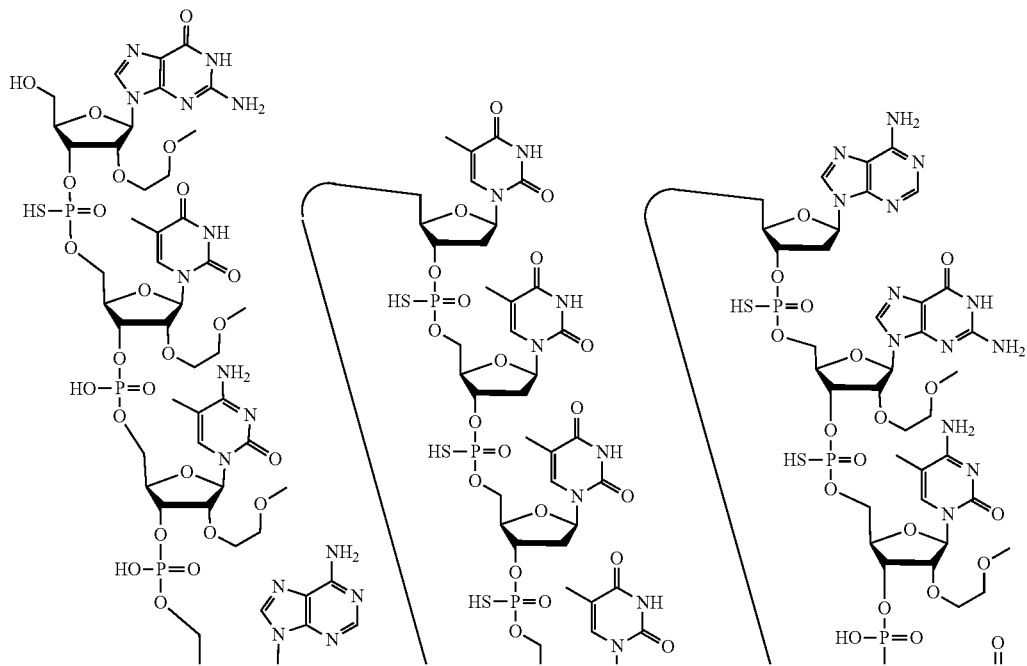

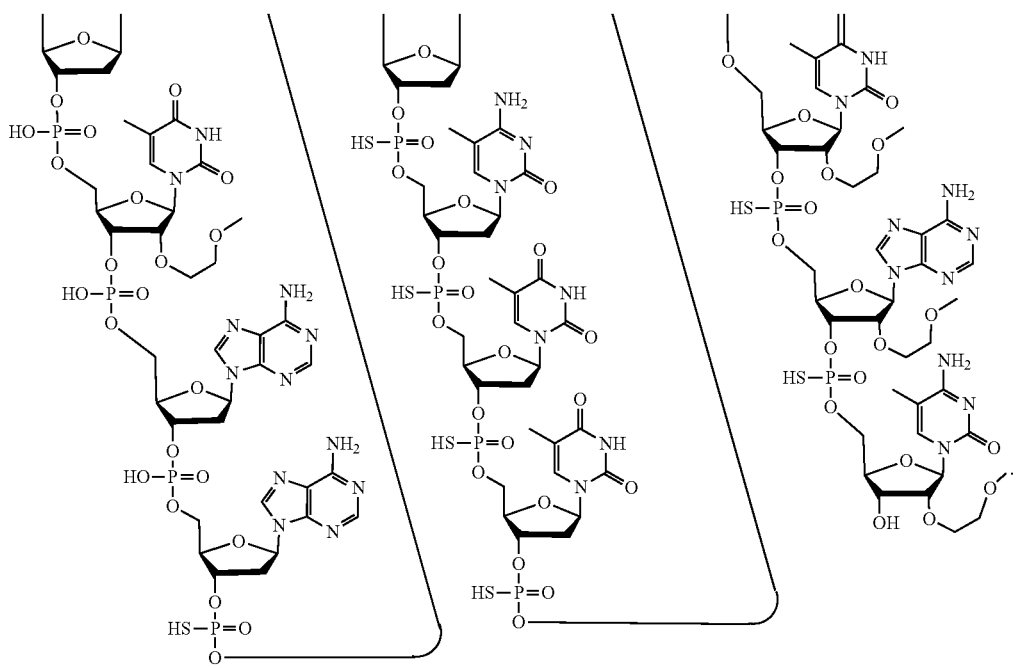

Structure 3. Compound No. 1373021

In certain embodiments, the sodium salt of Compound No. 1373021 is represented by the following chemical structure:

(SEQ ID NO: 1914)

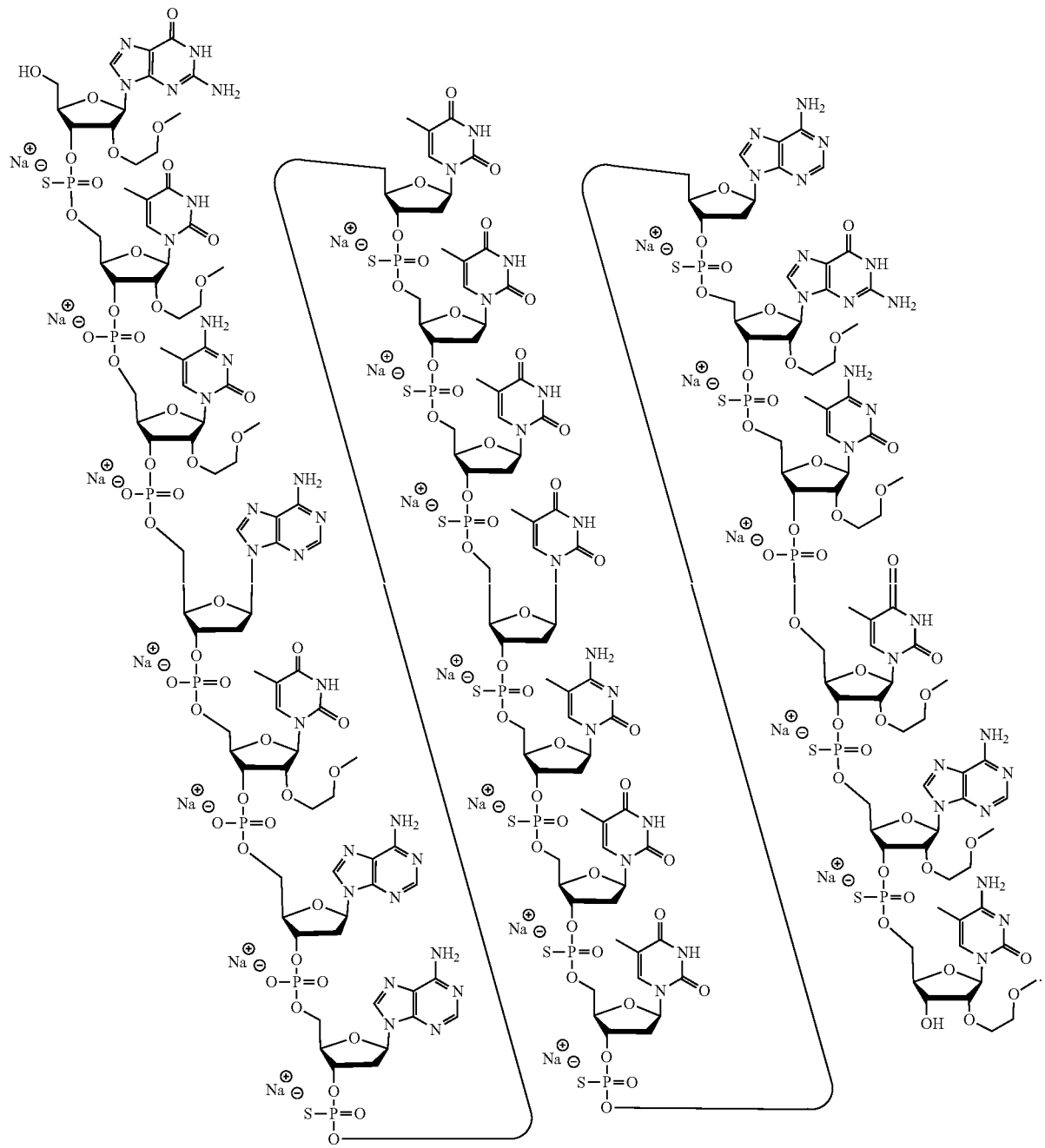

Structure 4. The Sodium Salt of Compound No. 1373021

3. Compound No. 1373022

In certain embodiments, Compound No. 1373022 is characterized as a 6-10-4 MOE gapmer having a sequence of (from 5' to 3') GCTTATTATTCATGTTCTCC (SEQ ID NO: 1939), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7 and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1373022 is represented by the following chemical notation (5' to 3'): Ges $^m$Ceo Teo Teo Aeo Teo Tds Ads Tds Tds $^m$Cds Ads Tds Gds Tds Tds $^m$Ceo Tes $^m$Ces $^m$Ce (SEQ ID NO: 1939), wherein, A=an adenine nucleobase,
$^m$C=a 5-methyl cytosine nucleobase,
G=a guanine nucleobase,
T=a thymine nucleobase,
e=a 2'-MOE modified sugar,
d=a 2'-β-D deoxyribosyl sugar,
s=a phosphorothioate internucleoside linkage, and
o=a phosphodiester internucleoside linkage.

In certain embodiments, Compound No. 1373099 is represented by the following chemical structure:

(SEQ ID NO: 1939)

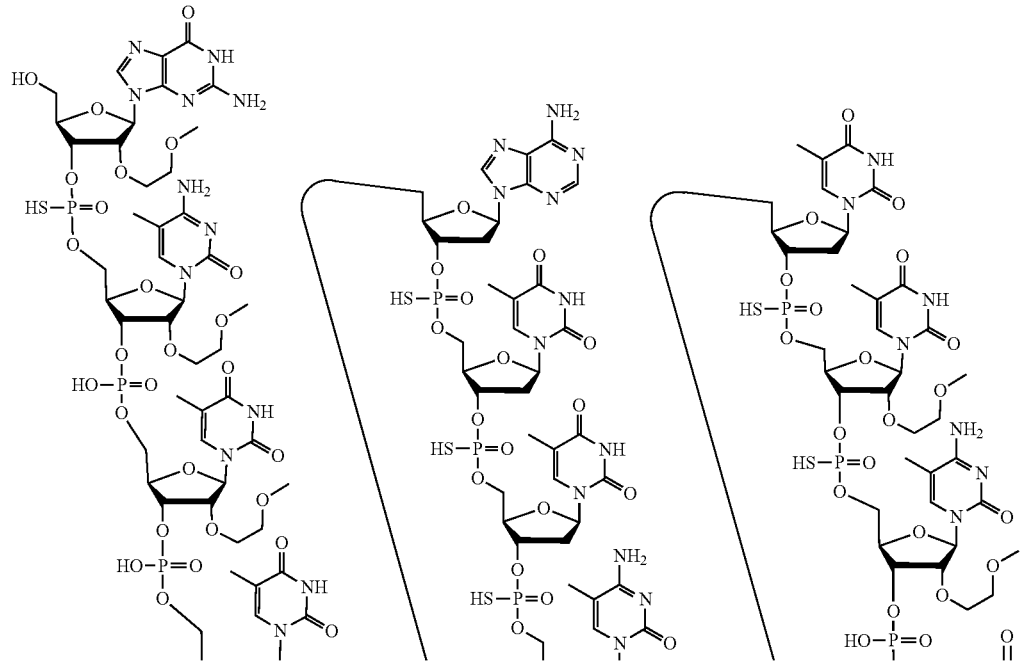

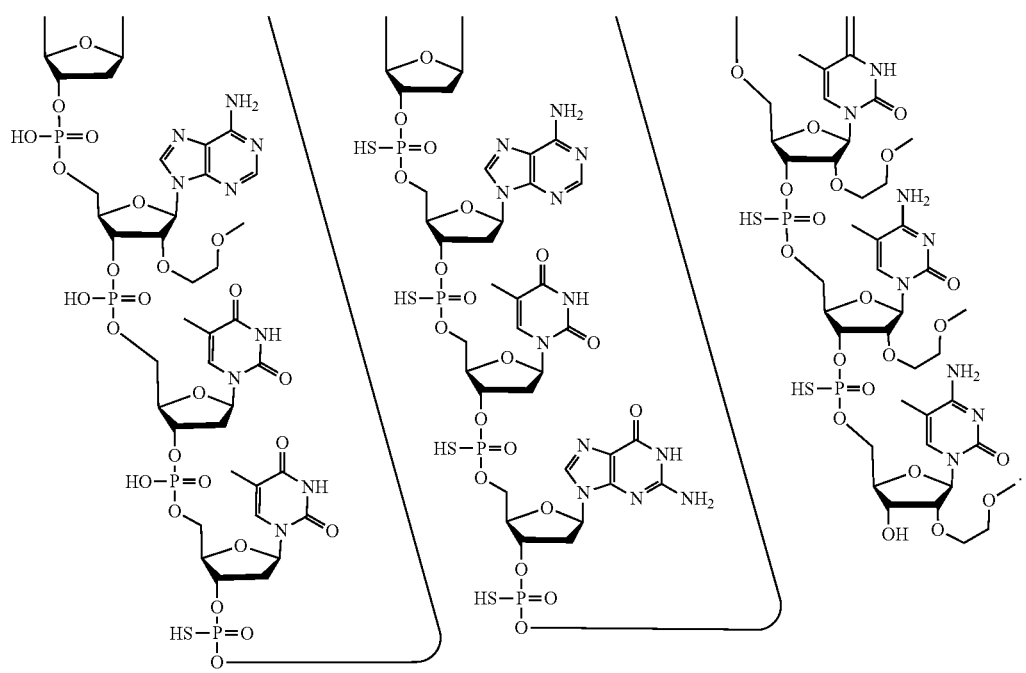

Structure 5. Compound No. 1373022

In certain embodiments, the sodium salt of Compound No. 1373022 is represented by the following chemical structure:

(SEQ ID NO: 1939)

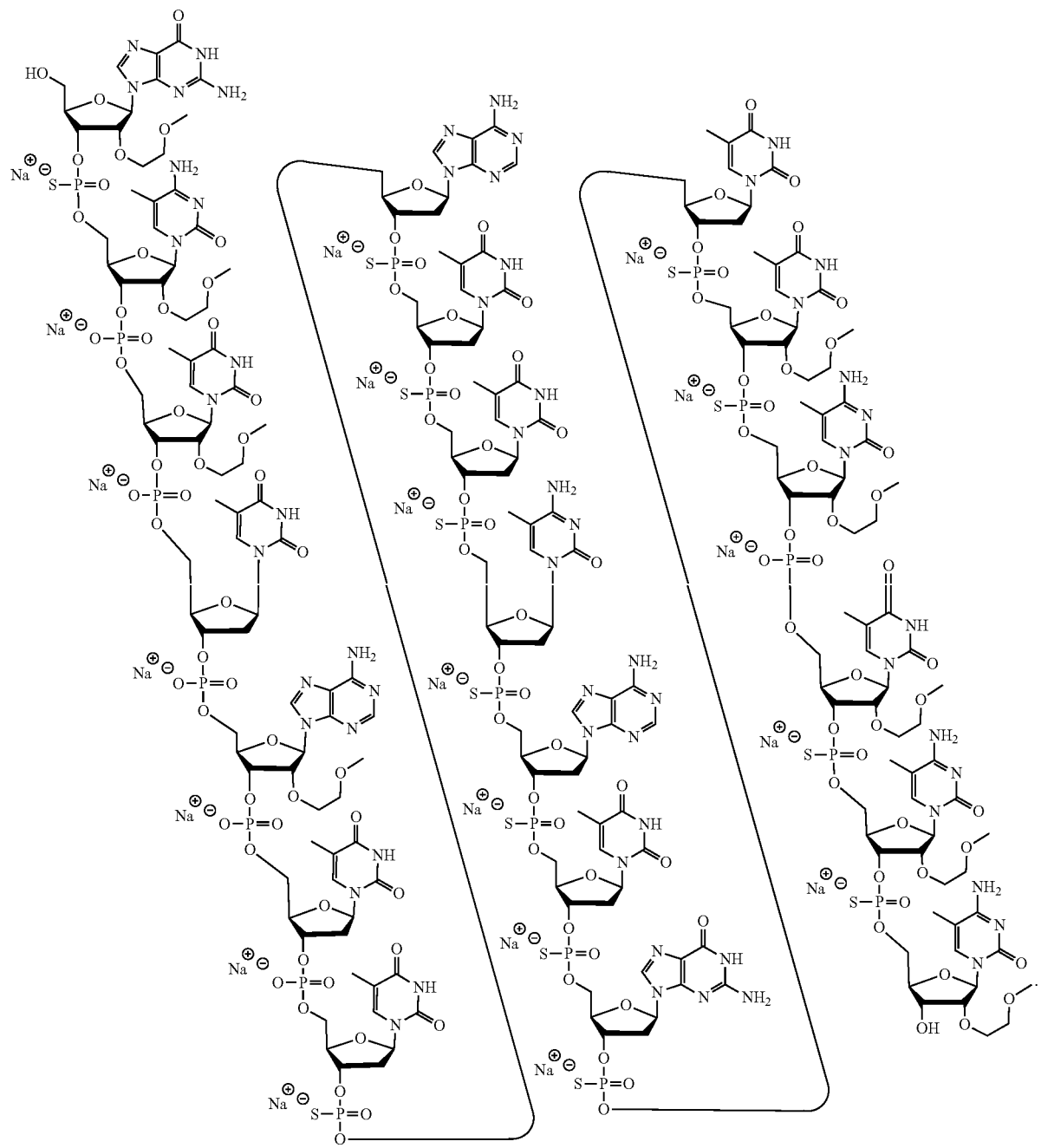

Structure 6. The Sodium Salt of Compound No. 1373022

4. Compound No. 1373023

In certain embodiments, Compound No. 1373023 is characterized as a 6-10-4 MOE gapmer having a sequence of (from 5' to 3') GTGTCATAATTTTCTTAGCT (SEQ ID NO: 2302), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7 and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1373023 is represented by the following chemical notation (5' to 3'): Ges Teo Geo Teo $^m$Ceo Aeo Tds Ads Ads Tds Tds Tds Tds $^m$Cds Tds Tds Aeo Ges $^m$Ces Te (SEQ ID NO: 2302), wherein,
  A=an adenine nucleobase,
  $^m$C=a 5-methyl cytosine nucleobase,
  G=a guanine nucleobase,
  T=a thymine nucleobase,
  e=a 2'-MOE modified sugar,
  d=a 2'-Q-D deoxyribosyl sugar,
  s=a phosphorothioate internucleoside linkage, and
  o=a phosphodiester internucleoside linkage.

In certain embodiments, Compound No. 1373023 is represented by the following chemical structure:

(SEQ ID NO: 2302)

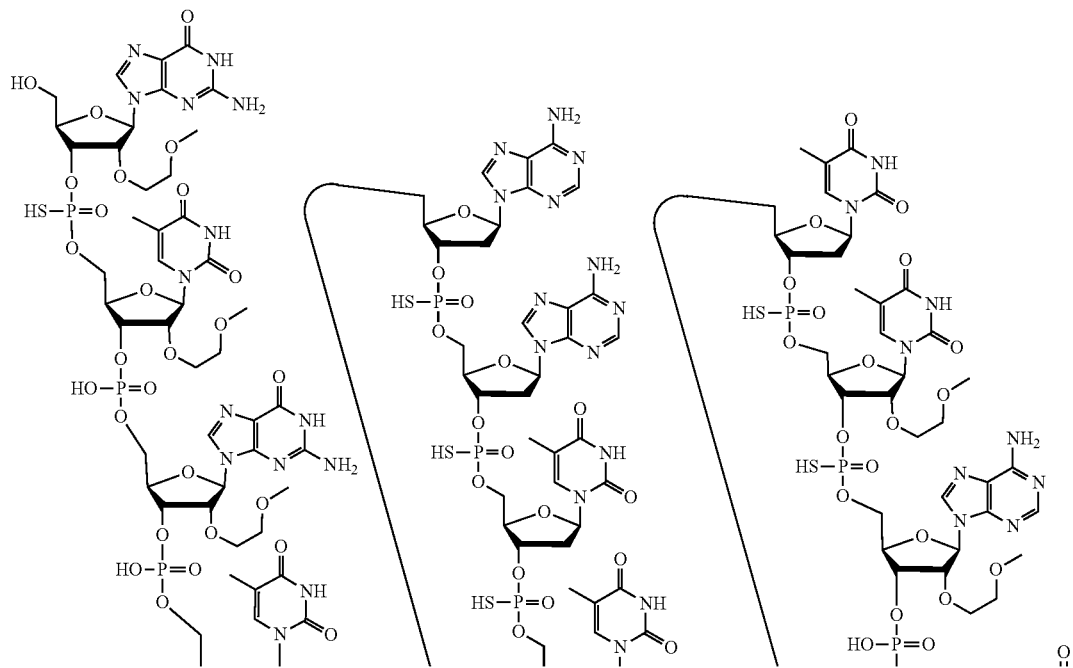

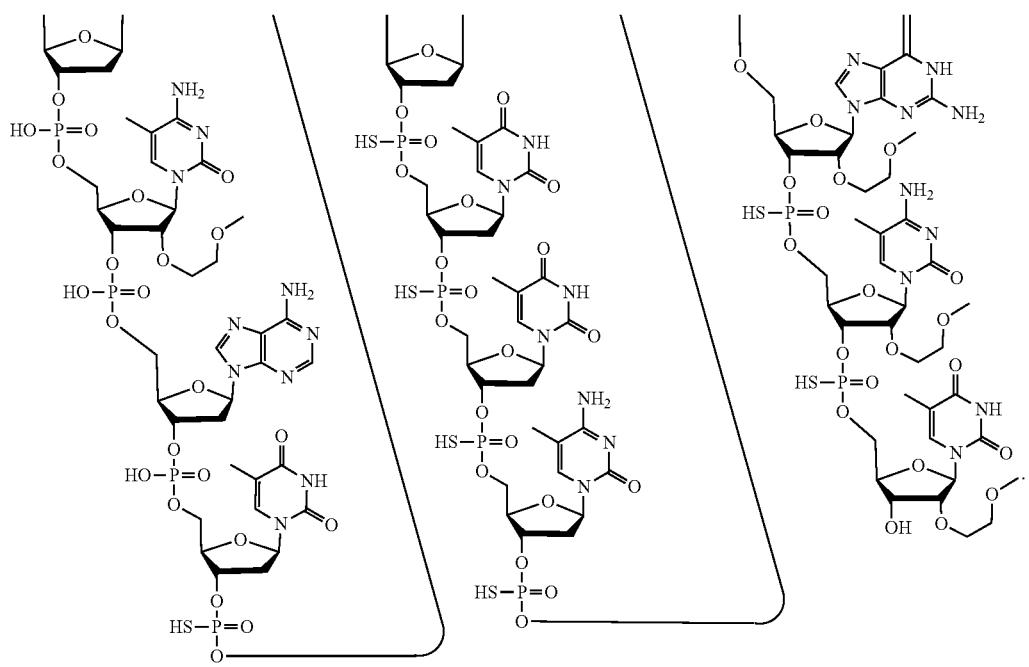

Structure 7. Compound No. 1332

In certain embodiments, the sodium salt of Compound No. 1373023 is represented by the following chemical structure:

(SEQ ID NO: 2302)

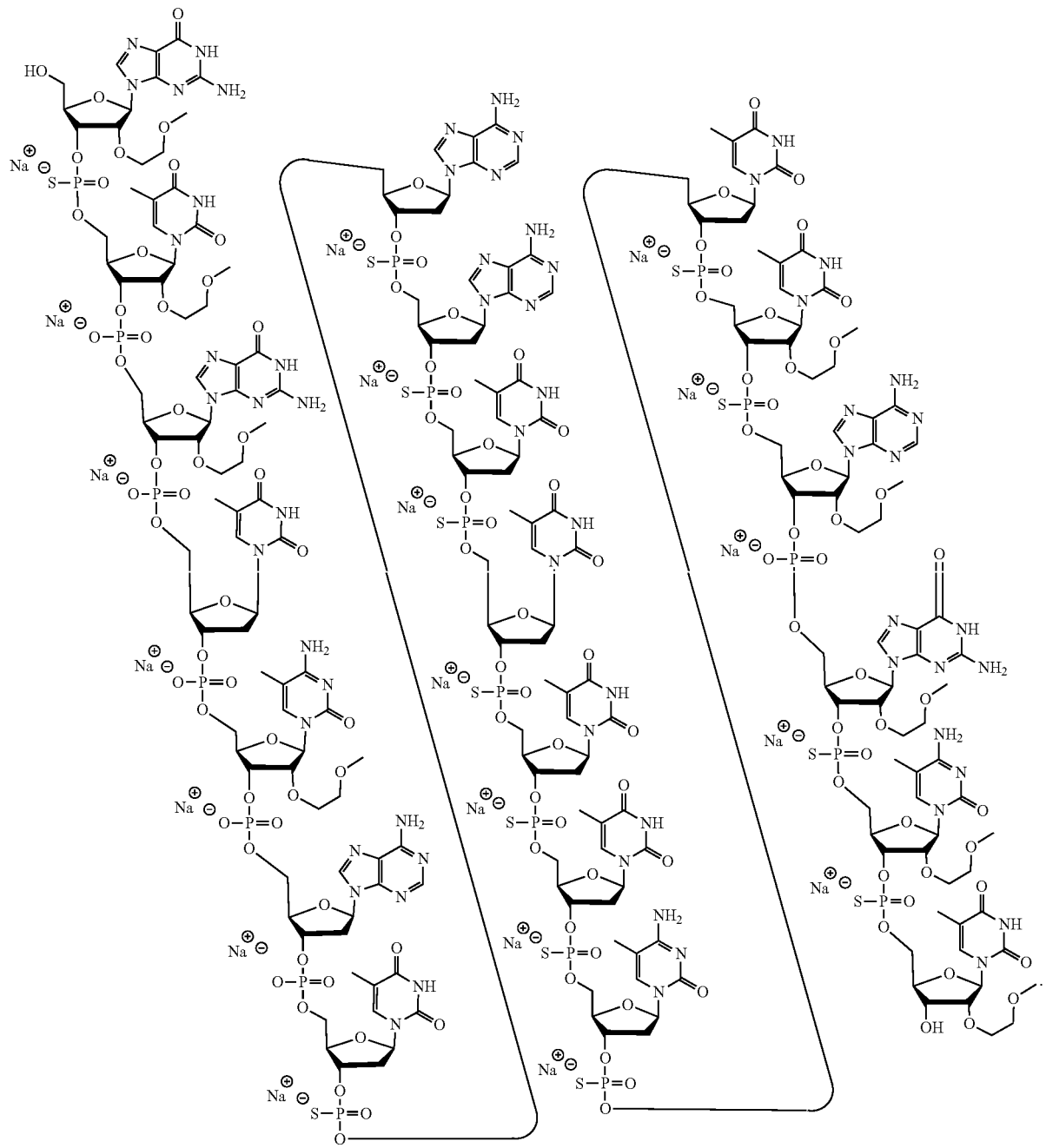

Structure 8. The Sodium Salt of Corn Pound No. 1373023

5. Compound No. 1373057

In certain embodiments, Compound No. 1373057 is characterized as a 5-9-5 MOE gapmer having a sequence of (from 5' to 3') GTCATAATTTTCTTAGCTA (SEQ ID NO: 2750), wherein each of nucleosides 1-5 and 15-19 (from 5' to 3') are 2'-MOE nucleosides and each of nucleosides 6-14 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, and 18 to 19 are phosphorothioate internucleoside linkages, and wherein each cytosine is a 5-methyl cytosine.

In certain embodiments, Compound No. 1373057 is represented by the following chemical notation (5' to 3'): Ges Teo $^m$Ceo Aeo Teo Ads Ads Tds Tds Tds $^m$Cds Tds Tds Aes Geo $^m$Ceo Tes Ae (SEQ ID NO: 2750), wherein, A=an adenine nucleobase,
$^m$C a 5-methyl cytosine nucleobase,
G=a guanine nucleobase,
T=a thymine nucleobase,
e=a 2'-MOE modified sugar,
d=a 2'-R-D deoxyribosyl sugar,
s=a phosphorothioate internucleoside linkage, and
o=a phosphodiester internucleoside linkage.

In certain embodiments, Compound No. 1373057 is represented by the following chemical structure:

(SEQ ID NO: 2750)

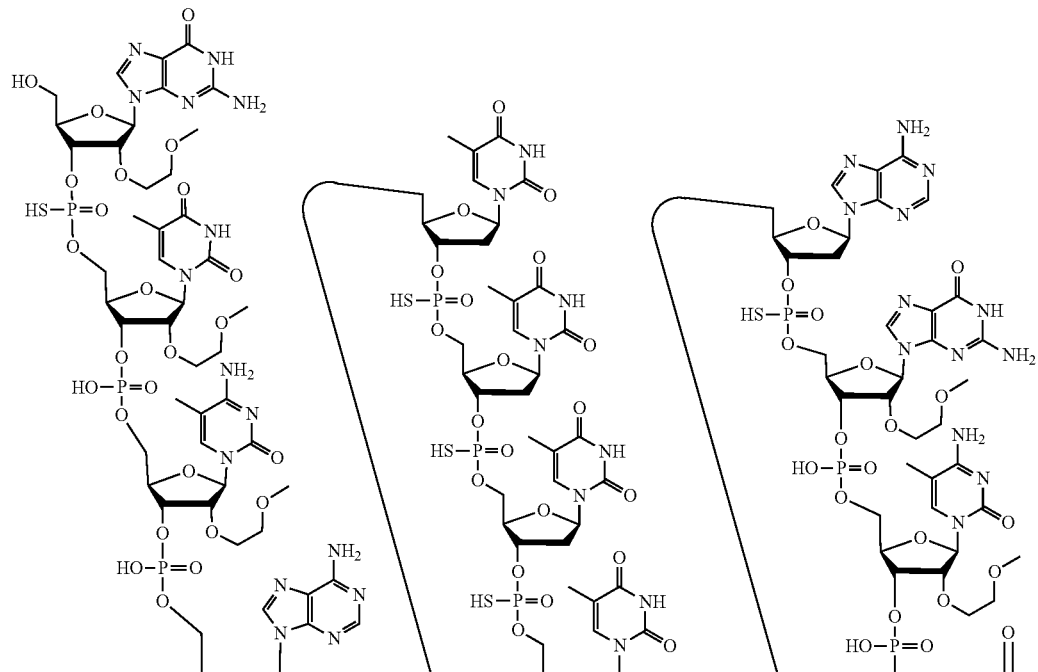

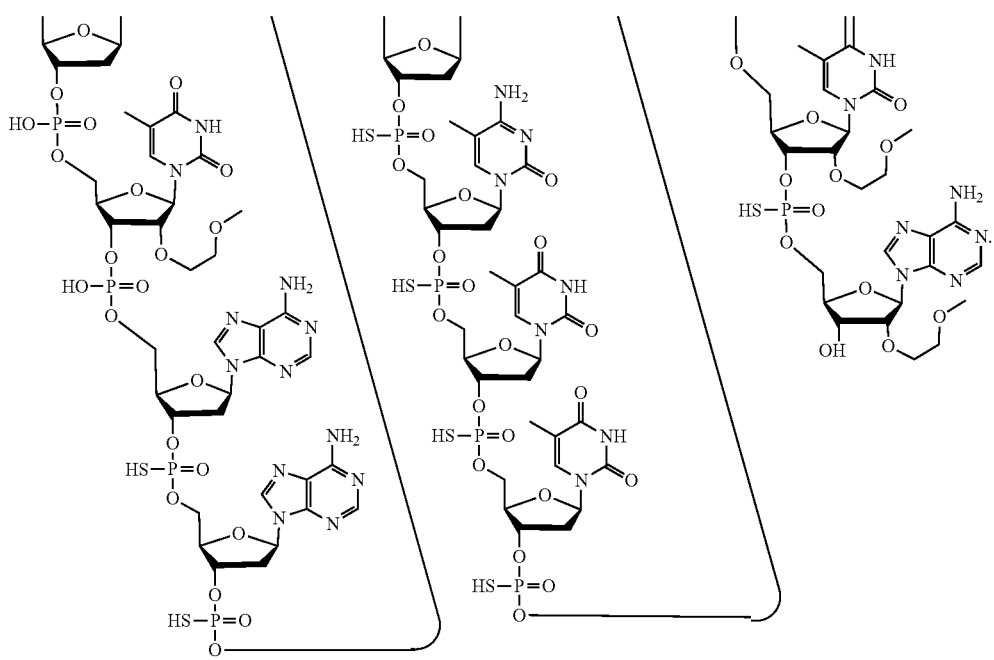

Structure 9. Compound No. 1373057

In certain embodiments, the sodium salt of Compound No. 1373057 is represented by the following chemical structure:

(SEQ ID NO: 2750)

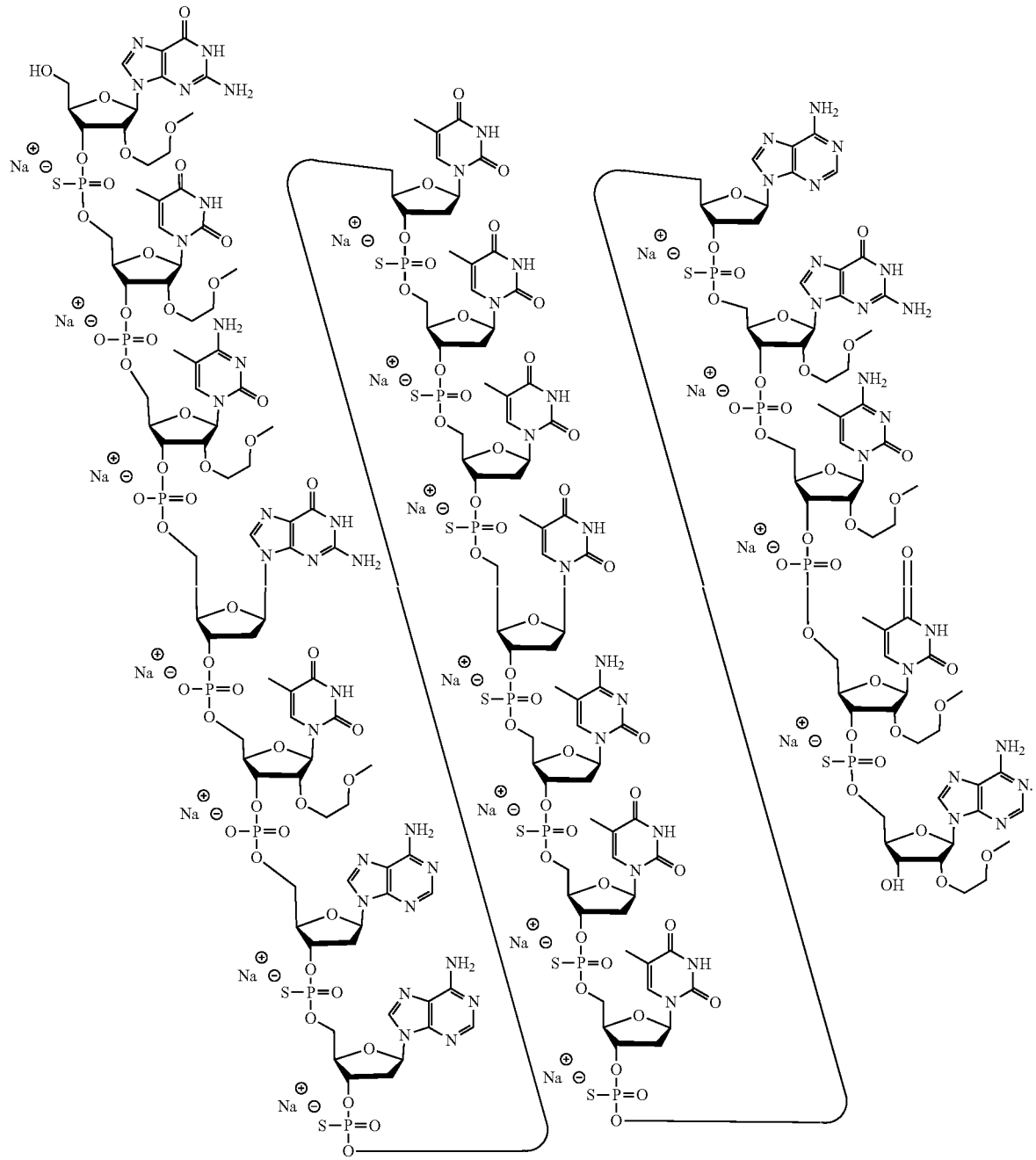

Structure 10. The Sodium Salt of Compound No. 1373057

6. Compound No. 1411016

In certain embodiments, Compound No. 1411016 is characterized as a 5-10-5 MOE gapmer having a sequence of (from 5' to 3') ACGTCCATTTTCTGTGCTTT (SEQ ID NO: 2739), wherein each of nucleosides 1-5 and 16-19 (from 5' to 3') are 2'-MOE nucleosides and each of nucleosides 6-15 are 2'-6l-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1411016 is represented by the following chemical notation (5' to 3'): Aes $^m$Ceo Geo Teo $^m$Ces $^m$Cds Ads Tds Tds Tds Tds $^m$Cds Tds Gds Tds Geo $^m$Ceo Tes Tes Te (SEQ ID NO: 2739), wherein, A=an adenine nucleobase,
$^m$C=a 5-methyl cytosine nucleobase,
G=a guanine nucleobase,
T=a thymine nucleobase,
e=a 2'-MOE modified sugar,
d=a 2'-Q-D deoxyribosyl sugar,
s=a phosphorothioate internucleoside linkage, and
o=a phosphodiester internucleoside linkage.

In certain embodiments, Compound No. 1411016 is represented by the following chemical structure:

(SEQ ID NO: 2739)

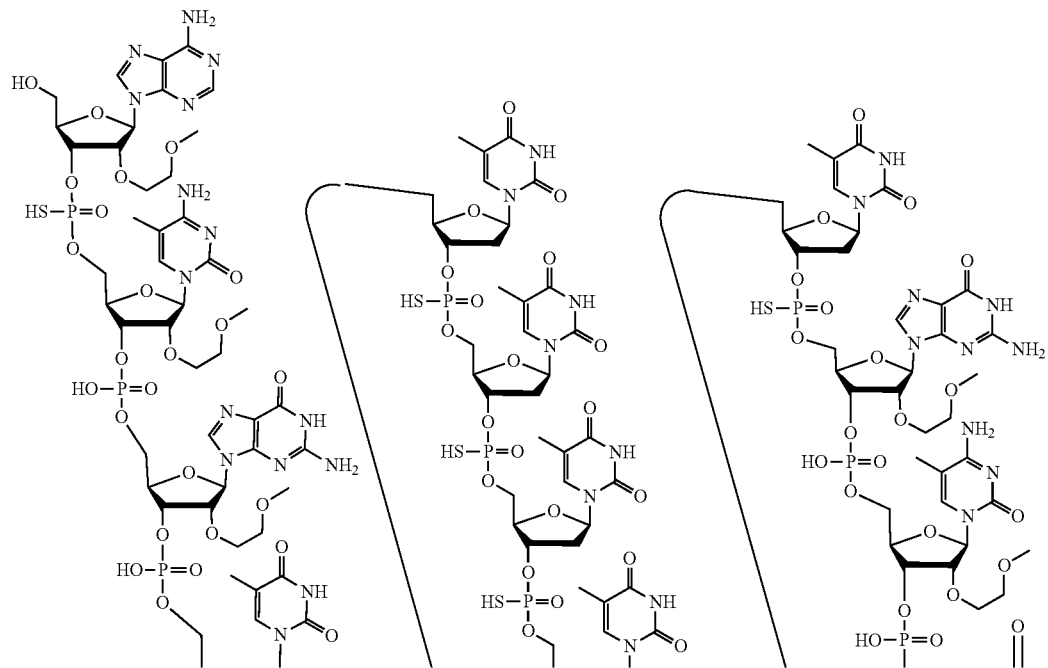

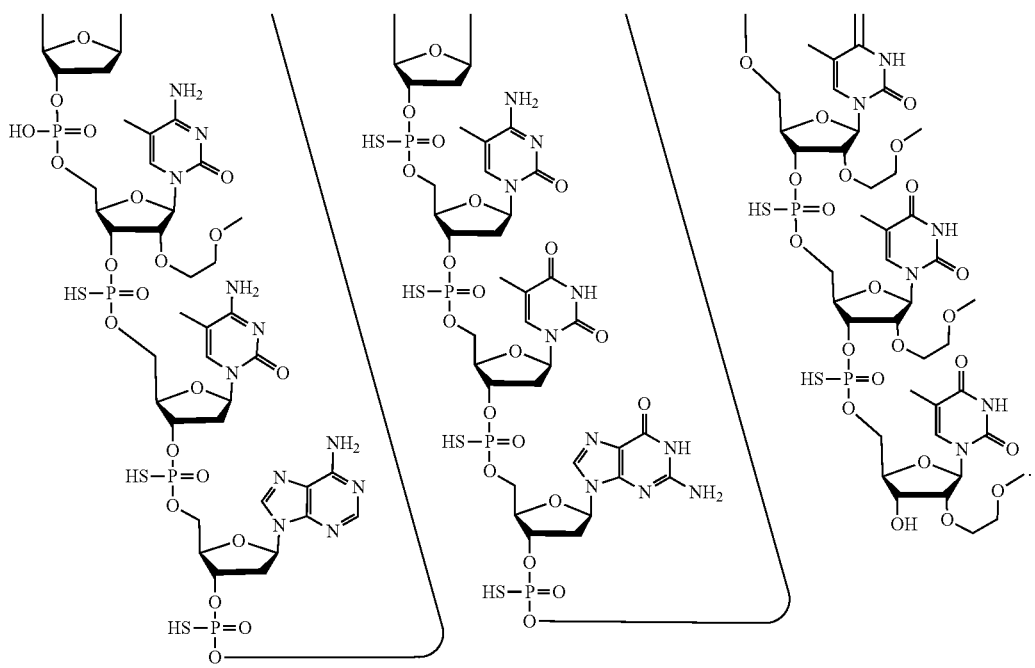

Structure 11. Compound No. 1411016

In certain embodiments, the sodium salt of Compound No. 1411016 is represented by the following chemical structure:

(SEQ ID NO: 2739)

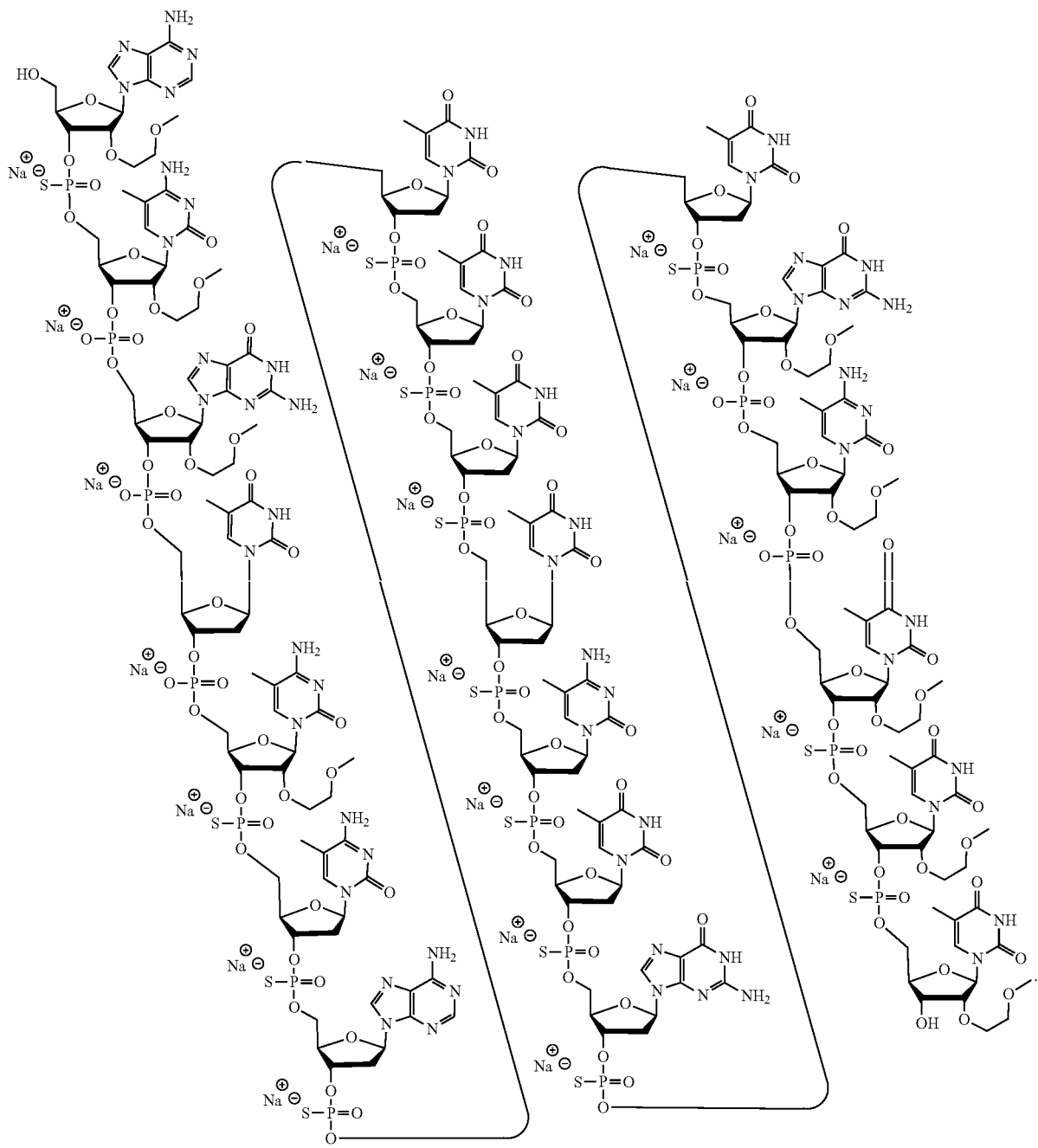

Structure 12. The Sodium Salt of Compound No. 1411016

VIII. Certain Comparator Compositions

In certain embodiments, Compound No. 169746, a 5-10-5 MOE gapmer having a sequence (from 5' to 3') of GTTATACTTTTACTGGCCTG (SEQ ID NO: 291), wherein each internucleoside linkage is a phosphorothioate internucleoside linkage, each cytosine is a 5-methyl cytosine, and wherein each of nucleosides 1-5 and 16-20 comprise a 2'-MOE modified sugar, which was previously described in WO2010/019270, incorporated herein by reference, is a comparator compound.

In certain embodiments, Compound No. 169750, a 5-10-5 MOE gapmer having a sequence (from 5' to 3') of TGCAT-ATTTCAAAGACCTGT (SEQ TD NO: 11), wherein each internucleoside linkage is a phosphorothioate internucleoside linkage, each cytosine is a 5-methyl cytosine, and wherein each of nucleosides 1-5 and 16-20 comprise a 2'-MOE modified sugar, which was previously described in WO2010/019270, incorporated herein by reference, is a comparator compound.

In certain embodiments, Compound No. 169753, a 5-10-5 MOE gapmer having a sequence (from 5' to 3') of GCCA-CATATAGGGTCCTTTA (SEQ ID NO: 66), wherein each internucleoside linkage is a phosphorothioate internucleoside linkage, each cytosine is a 5-methyl cytosine, and wherein each of nucleosides 1-5 and 16-20 comprise a 2'-MOE modified sugar, which was previously described in WO2010/019270, incorporated herein by reference, is a comparator compound.

In certain embodiments, Compound No. 169764, a 5-10-5 MOE gapmer having a sequence (from 5' to 3') of AGGGTCCTTTAAACATCTAA (SEQ ID NO: 450), wherein each internucleoside linkage is a phosphorothioate internucleoside linkage, each cytosine is a 5-methyl cytosine, and wherein each of nucleosides 1-5 and 16-20 comprise a 2'-MOE modified sugar, which was previously described in WO2010/019270, incorporated herein by reference, is a comparator compound.

Compound Nos. 169746, 169750, 169753, and 169764 were selected as comparator compounds because according to WO2010/019270, these compounds achieved >90% inhibition of PRNP RNA in a human cell line.

In certain embodiments, compounds described herein are superior relative to compounds described in WO2010/019270, because they demonstrate one or more improved properties, such as, in vivo efficacy and tolerability.

For example, as described herein, certain compounds Compound No. 1238994, Compound No. 1373021, Compound No. 1373022, Compound No. 1373023, Compound No. 1373057, and Compound No. 1411016 are more efficacious than comparator compounds in vivo. For example, as provided in Example 5, Compound No. 1238994, Compound No. 1373021, Compound No. 1373022, Compound No. 1373023, Compound No. 1373057, and Compound No. 1411016 achieve an average expression level (% control) of 27% (tables 65 and 75), 25% (tables 66 and 75), 30% (tables 66 and 75), 18% (tables 66 and 75), 25% (tables 66 and 75), and 24% (tables 71 and 72), respectively, in the spinal cord of transgenic mice, whereas comparator compounds Compound No. 169746, Compound No. 169750, and Compound No. 169764 achieve an average expression level (% control) of 52% (table 62), 61% (table 62), and 61% (table 62), respectively, in the spinal cord of transgenic mice. Therefore, certain compounds described herein are more efficacious than comparator compounds, Compound No. 169746, Compound No. 169750, and Compound No. 169764 in this assay.

For example, as provided in Example 5, Compound No. 1238994, Compound No. 1373021, Compound No. 1373022, Compound No. 1373023, Compound No. 1373057, and Compound No. 1411016 achieve an average expression level (% control) of 44% (tables 65 and 75), 33% (tables 66 and 75), 35% (tables 66 and 75), 28% (tables 66 and 75), 52% (tables 66 and 75), and 36% (tables 71 and 72), respectively, in the cortex of transgenic mice, whereas comparator compounds Compound No. 169746, Compound No. 169750, and Compound No. 169764 achieve an average expression level (% control) of 67% (table 62), 73% (table 62), and 77% (table 62), respectively, in the cortex of transgenic mice. Therefore, certain compounds described herein are more efficacious than comparator compounds, Compound No. 169746, Compound No. 169750, and Compound No. 169764 in this assay.

For example, as described herein, certain compounds Compound No. 1238994, Compound No. 1373021, Compound No. 1373022, Compound No. 1373023, Compound No. 1373057, and Compound No. 1411016 achieved average 3-hour FOB scores in mice of 0 (table 83), 2.5 (table 84), 1.8 (table 84), 0 (table 84), 0 (table 85), and 1.8 (table 94), respectively, at a dose of 700 μg. Compound No. 169753 achieved a 3-hour FOB scores in mouse of 4.2 (table 83). Therefore Compound No. 1238994, Compound No. 1373021, Compound No. 1373022, Compound No. 1373023, Compound No. 1373057, and Compound No. 1411016 described herein are more tolerable than comparator compound Compound No. 169753 in this assay.

For example, as described herein, certain compounds Compound No. 1238994, Compound No. 1373021, Compound No. 1373022, Compound No. 1373023, Compound No. 1373057, and Compound No. 1411016 achieved average 3-hour FOB scores in rat of 1.0 (table 107), 3.0 (table 97), 1.5 (table 97), 1.3 (table 97), 0.8 (table 98) and 3.3 (table 108), respectively, at a dose of 3 mg. Compound No. 169753 achieved a 3-hour FOB score in rat of 5.5 (table 106). Therefore Compound No. 1238994, Compound No. 1373021, Compound No. 1373022, Compound No. 1373023, Compound No. 1373057, and Compound No. 1411016 described herein are more tolerable than comparator compound Compound No. 169753 in this assay.

For example, as described herein, certain compounds Compound No. 1238994, Compound No. 1373021, Compound No. 1373022, Compound No. 1373023, Compound No. 1373057, and Compound No. 1411016, are more tolerable in a long-term study in rats than comparator Compound No. 169753. For example, as provided in Example 8, Compound No. 1238994, Compound No. 1373021, Compound No. 1373022, Compound No. 1373023, Compound No. 1373057, and Compound No. 1411016 had no onset of an adverse event during the course of the study. In contrast, each rat treated with Compound No. 169753 had adverse event onset by 5 weeks post-treatment. Therefore, certain compounds described herein are more tolerable than comparator compounds Compound No. 169753 in this assay.

IX. Certain Hotspot Regions

1. Nucleobases 5635-5677 of SEQ ID NO: 2

In certain embodiments, nucleobases 5635-5677 of SEQ ID NO: 2 comprise a hotspot region. In certain embodiments, modified oligonucleotides are complementary within nucleobases 5635-5677 of SEQ ID NO: 2. In certain embodiments, modified oligonucleotides are 16 nucleobases in length. In certain embodiments, modified oligonucleotides are 17 nucleobases in length. In certain embodiments, modified oligonucleotides are 19 nucleobases in length. In certain embodiments, modified oligonucleotides are 20 nucleobases in length. In certain embodiments, modified oligonucleotides are gapmers. In certain embodiments, modified oligonucleotides are 5-10-5, 6-10-4, 4-10-6, 5-9-5, 4-8-5, or 4-8-4 gapmers. In certain embodiments, the gapmers are MOE gapmers. In certain embodiments, the gapmers are mixed wing gapmers. In certain embodiments, the mixed wing gapmers have the sugar motif in order from 5' to 3': eeeeedddddddddkkeee, eeeeeedddddddddkkee, eeeeedddddddddkkeee, eeeedddddddkkeee, or eeeedddddddkkee; wherein 'd' represents a 2'-β-D-deoxyribosyl sugar moiety, 'k' represents a cEt sugar moiety, and 'e' represents a 2'-MOE sugar moiety. In certain embodiments, the nucleosides of the modified oligonucleotides are linked by phosphorothioate internucleoside linkages and phosphodiester internucleoside linkages. In certain embodiments, the phosphodiester ("o") and phosphorothioate ("s")

internucleoside linkages are arranged in order from 5' to 3': sooosssssssssssoooss, sooossssssssssssooss, sooooosssssssssssoss, sooooossssssssssssoos, soosssssssssssooss or soossssssssssoos.

The reduction of PRNP RNA in vitro in the standard cell assay. In certain embodiments, modified oligonucleotides complementary within nucleobases 14366-14410 of SEQ ID NO: 2 achieve an average of 39% reduction of PRNP RNA in the cortex in the standard in vivo assay.

4. Additional Hotspot Regions

In certain embodiments, the ranges described in the Table below comprise hotspot regions. Each hotspot region begins with the nucleobase of SEQ ID NO:1 identified in the "Start Site SEQ ID NO: 1" column and ends with the nucleobase of SEQ ID NO: 1 identified in the "Stop Site SEQ ID NO: 1" column, and/or begins with the nucleobase of SEQ ID NO: 2 identified in the "Start Site SEQ ID NO: 2" column and ends with the nucleobase of SEQ ID NO: 2 identified in the "Stop Site SEQ ID NO: 2" column. In certain embodiments, modified oligonucleotides are complementary within any of the hotspot regions 1-21, as defined in the table below. In certain embodiments, modified oligonucleotides are 16 nucleobases in length. In certain embodiments, modified oligonucleotides are 17 nucleobases in length. In certain embodiments, modified oligonucleotides are 18 nucleobases in length. In certain embodiments, modified oligonucleotides are 19 nucleobases in length. In certain embodiments, modified oligonucleotides are 20 nucleobases in length. In certain embodiments, modified oligonucleotides are gapmers. In certain embodiments, modified oligonucleotides are 5-10-5, 6-10-4, 4-10-6, 3-10-7, 7-10-3, 5-9-5, 5-8-5, 4-8-4, or 5-8-4 gapmers. In certain embodiments, the gapmers are MOE gapmers. In certain embodiments, the gapmers are mixed wing gapmers. In certain embodiments, the mixed wing gapmers have the sugar motif in order from 5' to 3': eeeeedddddddddkkeee, eeeeeedddddddddkkee, eeeeedddddddddkkeee, or eeeedddddddddkkee; wherein 'd' represents a 2'-β-D-deoxyribosyl sugar moiety, 'k' represents a cEt sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3'). In certain embodiments, the gapmers have the sugar motif in order from 5' to 3': eeeeedyddddddddeeeee or eeeedydddddddeeeee; wherein 'd' represents a 2'-β-D-deoxyribosyl sugar moiety, 'k' represents a cEt sugar moiety, 'e' represents a 2'-MOE sugar moiety, and 'y' represents a 2'-OMe sugar moiety. In certain embodiments, the nucleosides of the modified oligonucleotides are linked by phosphorothioate internucleoside linkages and phosphodiester internucleoside linkages. In certain embodiments, the phosphodiester ("o") and phosphorothioate ("s") internucleoside linkages are arranged in order from 5' to 3': sooosssssssss-sooooss, sooossssssssssoooss, sooosssssssssssooss, sooooosssssssssssoss, ssooooosssssssssssos, sooooosssssssss-soos, sooosssssssssssooss, soosssssssssooss, sooosssssssss-sooss, or sooossssssssssoos.

The nucleobase sequence of compounds listed in the "Compound No. in range" column in the table below are complementary to SEQ ID NO: 1 and/or SEQ ID NO: 2 within the specified hotspot region. The nucleobase sequence of the oligonucleotides listed in the "SEQ ID NO: in range" column in the table below are complementary to the target sequence, SEQ ID NO: 1 and/or SEQ ID NO: 2, within the specified hotspot region.

In certain embodiments, modified oligonucleotides complementary to nucleobases within the hotspot region achieve at least "Min. % Red. in vitro" (minimum % reduction, relative to untreated control cells) of PRNP RNA in vitro in the standard cell assay, as indicated in the table below. In certain embodiments, modified oligonucleotides complementary to nucleobases within the hotspot region achieve an average of "Avg. % Red. in vitro" (average % reduction, relative to untreated control cells) of PRNP RNA in vitro in the standard cell assay, as indicated in the table below. In certain embodiments, modified oligonucleotides complementary to nucleobases within the hotspot region achieve a maximum of "Max. % Red. in vitro" (maximum % reduction, relative to untreated control cells) of PRNP RNA in vitro in the standard cell assay, as indicated in the table below.

TABLE 1

Hotspot Regions of PRNP

| Hotspot ID | Start Site SEQ ID NO: 1 | Stop Site SEQ ID NO: 1 | Start Site SEQ ID NO: 2 | Stop Site SEQ ID NO: 2 | Min. % Reduction | Max. % Reduction | Avg. % Reduction | Compound ID in range | SEQ ID in range |
|---|---|---|---|---|---|---|---|---|---|
| 1 | n/a | n/a | 5633 | 5677 | 36 | 93 | 75 | 1238994-1239003, 1270398-1270400, 1270564, 1270668, 1373021, 1373023, 1373032, 1373034, 1373050, 1373057, 1373063, 1373065, 1418398-1418403, 1418409-1418411, 1418418-1418420, 1418423, 1418425 | 530, 607, 684, 761, 838, 915, 1914, 2069, 2146, 2237, 2301, 2302, 2536, 2640, 2750, 2759, 2760, 2764, 2788-2793, 2803-2806 |
| 2 | n/a | n/a | 5791 | 5826 | 55 | 92 | 77 | 1239051-1239054, 1270565, 1270415-1270419, 1270596, 1355720, 1411004-1411007, 1411013-1411016, 1418412-1418415, 1418426, 1423120-1423123, 1423126 | 1225, 1302, 1379, 1456, 2240, 2307, 2308, 2383, 2471, 2537, 2568, 2647, 2736-2739, 2744, 2798-2801 |
| 3 | n/a | n/a | 14366 | 14410 | 44 | 88 | 62 | 1239543-1239554, 1270516-1270521, 1270571, 1270640, 1355714, 1355734, | 555, 632, 709, 786, 863, 940, 1017, 1862, 1939, 2017, |

TABLE 1-continued

Hotspot Regions of PRNP

| Hotspot ID | Start Site SEQ ID NO: 1 | Stop Site SEQ ID NO: 1 | Start Site SEQ ID NO: 2 | Stop Site SEQ ID NO: 2 | Min. % Reduction | Max. % Reduction | Avg. % Reduction | Compound ID in range | SEQ ID in range |
|---|---|---|---|---|---|---|---|---|---|
| | | | | | | | | 1373022, 1373031, 1373051, 1373061, 1418404-1418407, 1418421, 1418426 | 2094, 2171, 2257, 2334, 2407, 2408, 2488, 2508, 2543, 2612, 2659, 2677, 2757, 2765, 2794-2797 |
| 4 | n/a | n/a | 4902 | 4929 | 72 | 98 | 90 | 1238802-1238805, 1270342-1270345 | 829, 906, 2060, 2137, 2228, 2283, 2446-2447 |
| 5 | n/a | n/a | 5000 | 5026 | 78 | 98 | 89 | 1238834-1238839 1270351-1270352 | 1446, 1523, 1600, 1676, 1753, 1830, 2285-2286 |
| 6 | n/a | n/a | 5073 | 5100 | 65 | 98 | 85 | 1201241, 1238863-1238864, 1270357-1270362 | 159, 524, 601, 2287-2288, 2231, 2373, 2452-2453 |
| 7 | n/a | n/a | 5515 | 5559 | 66 | 98 | 86 | 1238973-1238975, 1270373-1270387, 1270560-1270561, 1270593, 1270629, 1270666 | 529, 606, 683, 2233-2235, 2293-2297, 2376-2377, 2457-2461, 2532-2533, 2565, 2601, 2638 |
| 8 | n/a | n/a | 5595 | 5632 | 73 | 98 | 85 | 1201248, 1238987-1238992, 1270388-1270394 1270562-1270563, 1270594, 1270630 | 237, 1376, 1453, 1530, 1607, 1683, 1760, 2236, 2298-2300, 2378, 2462-2463, 2534-2535, 2566, 2602 |
| 9 | n/a | n/a | 5666 | 5690 | 74 | 97 | 87 | 1239008, 1239009, 1239010, 1239011, 1239012, 1270402, 1355708 | 1300, 1377, 1454, 1531, 1608, 2466 |
| 10 | n/a | n/a | 5857 | 5881 | 80 | 93 | 87 | 1239062-1239066 1270424 | 610, 687, 764, 1995, 2072, 2310 |
| 11 | n/a | n/a | 9352 | 9377 | 70 | 94 | 86 | 1239345-1239347, 1270486-1270488, 1270602 | 546, 1853, 1930, 2252, 2483, 2503, 2574 |
| 12 | n/a | n/a | 11331 | 11358 | 79 | 95 | 89 | 1239447-1239448, 1270510-1270515 | 1243, 1320, 2256, 2333, 2405, 2406, 2487, 2507 |
| 13 | 1329 | 1360 | 17120 | 17151 | 70 | 96 | 86 | 1238243-1238245, 1270227-1270233, 1270548, 1270579, 1335685, 1373020, 1373026-1373027, 1373029-1373030, 1373036-1373037, 1373042-1373046, 1373048, 1373053, 1373055, 1373058-1373060, 1373064, 1373067, 1373070, 1373072-1373075, 1418386, 1418388, 1418416, 1418390-1418393 | 1650, 1726, 1803, 2190-2191, 2264, 2342-2344, 2417, 2520, 2551, 2746, 2748, 2751, 2752, 2763, 2767-2768, 2778-2783 |
| 14 | 1420 | 1450 | 17211 | 17241 | 69 | 97 | 88 | 1201109, 1238254-1238255, 1270234-1270239, 1270580, 1270651 | 368, 804, 881, 2192-2193, 2265, 2345-2346, 2418, 2552, 2623 |
| 15 | 1490 | 1540 | 17281 | 17331 | 72 | 97 | 86 | 1238268-1238271, 1270246-1270253, 1270550, 1270582, 1270615, 1406261 | 497, 574, 651, 1881, 2196-2197, 2267, 2349-2351, |

TABLE 1-continued

Hotspot Regions of PRNP

| Hotspot ID | Start Site SEQ ID NO: 1 | Stop Site SEQ ID NO: 1 | Start Site SEQ ID NO: 2 | Stop Site SEQ ID NO: 2 | Min. % Reduction | Max. % Reduction | Avg. % Reduction | Compound ID in range | SEQ ID in range |
|---|---|---|---|---|---|---|---|---|---|
| 16 | 1619 | 1654 | 17410 | 17445 | 53 | 97 | 83 | 1201121, 1238284-1238286, 1270261-1270263, 1270583, 1270652 | 2420-2421, 2522, 2554, 2587, 2732 370, 1421, 1498, 1575, 2201, 2269, 2354, 2555, 2624 |
| 17 | 1810 | 1850 | 17601 | 17641 | 64 | 97 | 85 | 1238319-1238335, 1270264-1270266, 1270584, 1270653, 1355707 | 500, 807, 884, 961, 1038, 1115, 1192, 1269, 1346, 1423, 1500, 1577, 1654, 1730, 1807, 1884, 2115, 2202, 2355, 2423, 2556, 2625 |
| 18 | 1844 | 1879 | 17635 | 17670 | 69 | 96 | 82 | 1201138, 1238336-1238346, 1270269-1270272, 1270585 | 296, 577, 654, 731, 808, 885, 962, 1039, 1116, 1962, 2039, 2116, 2204, 2356-2357, 2424, 2557 |
| 19 | 1872 | 1921 | 17663 | 17712 | 66 | 97 | 81 | 1238356-1238374, 1270274-1270278, 1270586, 1270617-1270618 | 501, 578, 655, 732, 809, 886, 963, 1040, 1117, 1194, 1271, 1349, 1425, 1502, 1579, 1885, 1963, 2040, 2117, 2206, 2271, 2358-2359, 2425, 2558, 2589-2590 |
| 20 | 1962 | 1990 | 17753 | 17781 | 63 | 95 | 85 | 1201141-1201145, 1238398, 1270281-1270284, 1355706, 1373078, 1393330, 1393332, 1393334-1393335, 1393337-1393338, 1393342, 1418417, 1418422, 1418394-1418397 | 65-66, 143, 220, 297, 1733, 2208, 2360, 2426, 2427, 2754, 2755, 2771, 2772, 2776, 2784-2787 |
| 21 | 2194 | 2225 | 17985 | 18016 | 46 | 98 | 87 | 1238515-1238517, 1270306-1270311, 1270554, 1270622 | 1970, 2047, 2124, 2216-2217, 2277, 2365, 2434-2435, 2526, and 2594 |

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intenended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT^mCGAUCG," wherein ^mC indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as u or R such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1H$ hydrogen atoms. Isotopic substitutions encompassed by the compounds herein include but are not limited to: $^2H$ or $^3H$ in place of $^1H$, $^{13}C$ or $^{14}C$ in place of $^{12}C$, $^{15}N$ in place of $^{14}N$, $^{17}O$ or $^{18}O$ in place of $^{16}O$, and $^{33}S$, $^{34}S$, $^{35}S$, or $^{36}S$ in place of $^{32}S$. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Examples

Example 1: Effect of Modified Oligonucleotides on Human PRNP RNA In Vitro, Single Dose Modified oligonucleotides complementary to human PRNP nucleic acid were synthesized and tested for their effect on PRNP RNA levels in vitro.

The modified oligonucleotides in the tables below are 5-10-5 MOE gapmers with mixed internucleoside linkages. The gapmers are 20 nucleosides in length, wherein the central gap segment consists of ten 2'-β-D-deoxynucleosides and the 3' and 5' wings each consist of five 2'-MOE modified nucleosides. The sugar motif of the gapmers is (from 5' to 3'): eeeeedddddddddddeeeee; wherein "d" represents a 2'-β-D-deoxyribosyl sugar, and 'e' represents a 2'-MOE modified ribosyl sugar. The internucleoside linkage motif for the gapmers is (from 5' to 3'): sooossssssssssssooss; wherein 'o' represents a phosphodiester internucleoside linkage and 's' represents a phosphorothioate internucleoside linkage. Each cytosine residue is a 5-methyl cytosine.

"Start site" indicates the 5'-most nucleoside to which the gapmer is complementary to in the human gene sequence. "Stop site" indicates the 3'-most nucleoside to which the gapmer is complementary to in the human gene sequence. Most of the modified oligonucleotides listed in the Tables below are complementary to the human PRNP mRNA sequence, designated herein as SEQ ID NO: 1 (GENBANK Accession NO: NM_000311.4) and/or the human PRNP genomic sequence, designated herein as SEQ ID NO: 2 (GENBANK Accession NO: NC_000020.11 truncated from nucleotides 4683001 to 4705000). In addition, certain modified oligonucleotides are complementary to the human PRNP mRNA designated herein as SEQ ID NO: 3 (GENBANK Accession NO: NM_001080123.2). 'N/A' indicates that the modified oligonucleotide is not complementary to that particular gene sequence with 100% complementarity.

Cultured A431 cells at a density of 20,000 cells per well were treated with 4,000 nM of modified oligonucleotide by free uptake. After a treatment period of approximately 48 hours, total RNA was isolated from the cells and PRNP RNA levels were measured by quantitative real-time RTPCR. Human PRNP primer probe set RTS42354 (forward sequence CCTCTCCTCACGACCGA, designated herein as SEQ ID NO: 21; reverse sequence CCCAGTGTTC-CATCCTCCA, designated herein as SEQ ID NO: 22; probe sequence CCACAAAGAGAACCAGCATCCAGCA, designated herein as SEQ ID NO: 23) was used to measure RNA levels. In addition, mRNA levels modulated by modified oligonucleotides described herein in tables 12 and 13 were measured using an additional human PRNP primer probe set, RTS42359 (forward sequence AGTG-GAACAAGCCGAGTAAG, designated herein as SEQ ID NO: 24; reverse sequence CCTCATAGT-CACTGCCGAAAT, designated herein as SEQ ID NO: 25; probe sequence AACCAACATGAAGCACATGGCTGG, designated herein as SEQ ID NO: 26). PRNP RNA levels were normalized using RIBOGREEN®. Results are presented in the tables below are normalized to PRNP RNA levels in untreated control cells (UTC). Values marked with an asterisk (*) result from oligonucleotides that are complementary to the amplicon region of the primer probe set. Additional assays may be used to measure the potency and efficacy of the modified oligonucleotides complementary to the amplicon region.

TABLE 2

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1200909 | 12 | 31 | 3105 | 3124 | CCCCGTTACATAATGGAGAA | 92 | 27 |
| 1200915 | 96 | 115 | 3189 | 3208 | GCCTGCGGGTGCCATCGCTC | 90 | 28 |
| 1200921 | 105 | 124 | 3198 | 3217 | GTTGATACCGCCTGCGGGTG | 99 | 29 |
| 1200927 | 112 | 131 | 3205 | 3224 | TGCATCAGTTGATACCGCCT | 90 | 30 |
| 1200933 | 161 | 180 | 3254 | 3273 | GCCGGGAATGAGTCACCGGA | 86 | 31 |
| 1200939 | 211 | 230 | 3304 | 3323 | CGGGCGGCCGGCCGAGGTTT | 91 | 32 |
| 1200945 | 236 | 255 | 3329 | 3348 | CCCGGCGCACACTCTGTGCC | 98 | 33 |
| 1200951 | 251 | 270 | 3344 | 3363 | CCAATTGCCGCGCGGCCCGG | 84 | 34 |
| 1200957 | 340 | 359 | 3433 | 3452 | GAGGACAGGCGACGCGCGGG | 95 | 35 |
| 1200965 | 353 | 372 | 3446 | 3465 | AGCGACTGGCTCGGAGGACA | 95 | 36 |
| 1200971 | 384 | 403 | 3477 | 3496 | GAGAGGAGAAGCTCGCGGCG | 84* | 37 |
| 1200977 | 422 | 441 | 16213 | 16232 | AAGGTTCGCCATAATGACTG | 23* | 38 |
| 1200983 | 524 | 543 | 16315 | 16334 | GTATCGGCTGCCCCCAGTGT | 53* | 39 |
| 1200989 | 531 | 550 | 16322 | 16341 | GCCCCGGGTATCGGCTGCCC | 131* | 40 |
| 1200995 | 560 | 579 | 16351 | 16370 | TGGGTAGCGGTTGCCTCCAG | 91 | 41 |
| 1201001 | 571 | 590 | 16362 | 16381 | CCGCCCTGAGGTGGGTAGCG | 89 | 42 |
| 1201007 | 725 | 744 | 16516 | 16535 | TGGCTTACTCGGCTTGTTCC | 41 | 43 |
| 1201013 | 798 | 817 | 16589 | 16608 | GCATGTAGCCGCCAAGGCCC | 86 | 44 |
| 1201019 | 826 | 845 | 16617 | 16636 | ATGATGGGCCTGCTCATGGC | 70 | 45 |
| 1201025 | 851 | 870 | 16642 | 16661 | GTCCTCATAGTCACTGCCGA | 68 | 46 |
| 1201031 | 869 | 888 | 16660 | 16679 | GTTTTCACGATAGTAACGGT | 39 | 47 |
| 1201037 | 904 | 923 | 16695 | 16714 | GGCCTGTAGTACACTTGGTT | 85 | 48 |
| 1201043 | 920 | 939 | 16711 | 16730 | GCTGTACTCATCCATGGGCC | 93 | 49 |
| 1201049 | 981 | 1000 | 16772 | 16791 | TGGTGACCGTGTGCTGCTTG | 51 | 50 |
| 1201055 | 1003 | 1022 | 16794 | 16813 | AAGTTCTCCCCCTTGGTGGT | 50 | 51 |
| 1201061 | 1016 | 1035 | 16807 | 16826 | GTCGGTCTCGGTGAAGTTCT | 52 | 52 |
| 1201067 | 1046 | 1065 | 16837 | 16856 | CTGCTCAACCACGCGCTCCA | 60 | 53 |
| 1201075 | 1095 | 1114 | 16886 | 16905 | CTCTCTGGTAATAGGCCTGA | 63 | 54 |
| 1201081 | 1228 | 1247 | 17019 | 17038 | CGCCTCCCTCAAGCTGGAAA | 93 | 55 |
| 1201087 | 1238 | 1257 | 17029 | 17048 | AGGTGGATACCGCCTCCCTC | 85 | 56 |
| 1201093 | 1307 | 1326 | 17098 | 17117 | AGGGTATTGATTAGCCTATC | 55 | 57 |
| 1201099 | 1393 | 1412 | 17184 | 17203 | AGCAACGGCTCATGATGAAC | 25 | 58 |
| 1201105 | 1404 | 1423 | 17195 | 17214 | GGCCTGGCATTAGCAACGGC | 80 | 59 |
| 1201111 | 1472 | 1491 | 17263 | 17282 | AACCTGTTGCACTAAGTCCA | 17 | 60 |
| 1201117 | 1561 | 1580 | 17352 | 17371 | GCATTAGTATACTGAGCTCT | 48 | 61 |
| 1201123 | 1651 | 1670 | 17442 | 17461 | GGCCTCCTAACAAACCTGGC | 77 | 62 |
| 1201129 | 1742 | 1761 | 17533 | 17552 | TCTCGGTACACACAGAGCTC | 98 | 63 |

TABLE 2-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201135 | 1788 | 1807 | 17579 | 17598 | AGCTGCTGTGTAGCCCATAC | 26 | 64 |
| 1201141 | 1962 | 1981 | 17753 | 17772 | CCACATATAGGGTCCTTTAA | 18 | 65 |
| 1201142 | 1963 | 1982 | 17754 | 17773 | GCCACATATAGGGTCCTTTA | 9 | 66 |
| 1201148 | 2585 | 2604 | 18376 | 18395 | CACGCAAAAGGGTTTCCCAC | 58 | 67 |
| 1201154 | 2607 | 2626 | 18398 | 18417 | TGCACATTGTAAGCCTAAGG | 6 | 68 |
| 1201160 | N/A | N/A | 3553 | 3572 | TCACTCGGCCCCCGCGGCTC | 99 | 69 |
| 1201166 | N/A | N/A | 3592 | 3611 | CCGGGCACCCTTGCGCCTGG | 93 | 70 |
| 1201172 | N/A | N/A | 3691 | 3710 | CCCGAGCGGAGACCAGCGCA | 74 | 71 |
| 1201178 | N/A | N/A | 3702 | 3721 | AAGCCGCCTCACCCGAGCGG | 84 | 72 |
| 1201184 | N/A | N/A | 3755 | 3774 | CCAGCCCCCAACGCGCAGT | 71 | 73 |
| 1201190 | N/A | N/A | 3848 | 3867 | CGATCGCCCGCTGGGCCGGA | 78 | 74 |
| 1201196 | N/A | N/A | 3872 | 3891 | CTCCCGGAGTTCCCTGGGCG | 88 | 75 |
| 1201204 | N/A | N/A | 3981 | 4000 | TGGGCCCCGATCTCGGCCTC | 85 | 76 |
| 1201210 | N/A | N/A | 4071 | 4090 | CCGGAACTCCCCCGGCGGGC | 73 | 77 |
| 1201216 | N/A | N/A | 4081 | 4100 | ACCGAGGCTCCCGGAACTCC | 84 | 78 |
| 1201222 | N/A | N/A | 4180 | 4199 | ACGGCCGCAAGGCTGCAGCC | 71 | 79 |
| 1201228 | N/A | N/A | 4227 | 4246 | CGCCCCGCCCGTCAGTCCG | 84 | 80 |
| 1201234 | N/A | N/A | 4604 | 4623 | TGACCGTGGTGGAATTGCGA | 49 | 81 |
| 1201240 | N/A | N/A | 4759 | 4778 | TGCTAATTAAACCGTGATGC | 32 | 82 |
| 1201246 | N/A | N/A | 5419 | 5438 | GCCCCCAATAACTCATACAT | 91 | 83 |
| 1201252 | N/A | N/A | 5744 | 5763 | GGTGCAGTTAATAACCCACT | 69 | 84 |
| 1201258 | N/A | N/A | 6539 | 6558 | TAGTTGGTTGACAGCCATGT | 68 | 85 |
| 1201264 | N/A | N/A | 6850 | 6869 | ACCTCCCTTAAAGTGATCAC | 81 | 86 |
| 1201270 | N/A | N/A | 6986 | 7005 | AGTCAGAGAGTGCCTAGCGA | 57 | 87 |
| 1201276 | N/A | N/A | 7283 | 7302 | GCTTAATTAGTTACATCGGG | 3 | 88 |
| 1201282 | N/A | N/A | 7390 | 7409 | AGCTAGTAAGAACTTATCCC | 46 | 89 |
| 1201288 | N/A | N/A | 9029 | 9048 | TCTTAGATTTTGGACGGGA | 12 | 90 |
| 1201294 | N/A | N/A | 9692 | 9711 | AGCTCTATTAATAGGTTAGG | 9 | 91 |
| 1201300 | N/A | N/A | 10098 | 10117 | GCGGTGATGCCATCTACTGA | 86 | 92 |
| 1201306 | N/A | N/A | 10591 | 10610 | GTGGACTGCTAAGACTAGGG | 22 | 93 |
| 1201312 | N/A | N/A | 10805 | 10824 | GCTATATATAGGTGACCCAC | 76 | 94 |
| 1201318 | N/A | N/A | 12095 | 12114 | GCACGATAAAGCTGACTCTG | 61 | 95 |
| 1201324 | N/A | N/A | 13539 | 13558 | TGCAATTAGTGTGATCATGC | 33 | 96 |
| 1201330 | N/A | N/A | 13750 | 13769 | AGTGGCCTAGTCCTCTGGCA | 83 | 97 |
| 1201336 | N/A | N/A | 13946 | 13965 | AGTTAAGGATCTATGAGCTC | 74 | 98 |
| 1201342 | N/A | N/A | 14282 | 14301 | CGCTTGACCCATAGACATGC | 66 | 99 |

TABLE 2-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201348 | N/A | N/A | 14624 | 14643 | TGGGCCCCATGTAACCTGGT | 97 | 100 |
| 1201354 | N/A | N/A | 14721 | 14740 | TCCTCTTAATATGCGGGTCA | 74 | 101 |
| 1201360 | N/A | N/A | 14819 | 14838 | GACCATCTTATTCGGTGCTT | 41 | 102 |
| 1201366 | N/A | N/A | 14939 | 14958 | CCAATGCTCTAGAGTGACTG | 79 | 103 |
| 1201372 | N/A | N/A | 15466 | 15485 | GCAACCGAAACTGTTGCCAA | 81 | 104 |

TABLE 3

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1200910 | 14 | 33 | 3107 | 3126 | CTCCCCGTTACATAATGGAG | 76 | 105 |
| 1200916 | 98 | 117 | 3191 | 3210 | CCGCCTGCGGGTGCCATCGC | 102 | 106 |
| 1200922 | 106 | 125 | 3199 | 3218 | AGTTGATACCGCCTGCGGGT | 70 | 107 |
| 1200928 | 114 | 133 | 3207 | 3226 | CTTGCATCAGTTGATACCGC | 89 | 108 |
| 1200934 | 162 | 181 | 3255 | 3274 | GGCCGGGAATGAGTCACCGG | 104 | 109 |
| 1200940 | 212 | 231 | 3305 | 3324 | GCGGGCGGCCGGCCGAGGTT | 78 | 110 |
| 1200946 | 241 | 260 | 3334 | 3353 | CGCGGCCCGGCGCACACTCT | 77 | 111 |
| 1200952 | 253 | 272 | 3346 | 3365 | GACCAATTGCCGCGCGGCCC | 80 | 112 |
| 1200958 | 341 | 360 | 3434 | 3453 | GGAGGACAGGCGACGCGCGG | 113 | 113 |
| 1200966 | 355 | 374 | 3448 | 3467 | TCAGCGACTGGCTCGGAGGA | 98 | 114 |
| 1200972 | 416 | 435 | 16207 | 16226 | CGCCATAATGACTGCTCTGC | 19* | 115 |
| 1200978 | 424 | 443 | 16215 | 16234 | CCAAGGTTCGCCATAATGAC | 25* | 116 |
| 1200984 | 525 | 544 | 16316 | 16335 | GGTATCGGCTGCCCCCAGTG | 20* | 117 |
| 1200990 | 532 | 551 | 16323 | 16342 | TGCCCCGGGTATCGGCTGCC | 108* | 118 |
| 1200996 | 561 | 580 | 16352 | 16371 | GTGGGTAGCGGTTGCCTCCA | 91 | 119 |
| 1201002 | 574 | 593 | 16365 | 16384 | CCACCGCCCTGAGGTGGGTA | 54 | 120 |
| 1201008 | 726 | 745 | 16517 | 16536 | TTGGCTTACTCGGCTTGTTC | 35 | 121 |
| 1201014 | 799 | 818 | 16590 | 16609 | AGCATGTAGCCGCCAAGGCC | 88 | 122 |
| 1201020 | 829 | 848 | 16620 | 16639 | TGTATGATGGGCCTGCTCAT | 69 | 123 |
| 1201026 | 852 | 871 | 16643 | 16662 | GGTCCTCATAGTCACTGCCG | 72 | 124 |
| 1201032 | 878 | 897 | 16669 | 16688 | ACGGTGCATGTTTTCACGAT | 69 | 125 |
| 1201038 | 905 | 924 | 16696 | 16715 | GGGCCTGTAGTACACTTGGT | 79 | 126 |
| 1201044 | 942 | 961 | 16733 | 16752 | CGTGCACAAAGTTGTTCTGG | 87 | 127 |
| 1201050 | 982 | 1001 | 16773 | 16792 | GTGGTGACCGTGTGCTGCTT | 55 | 128 |
| 1201056 | 1008 | 1027 | 16799 | 16818 | CGGTGAAGTTCTCCCCCTTG | 67 | 129 |
| 1201062 | 1017 | 1036 | 16808 | 16827 | CGTCGGTCTCGGTGAAGTTC | 58 | 130 |

TABLE 3-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201068 | 1047 | 1066 | 16838 | 16857 | TCTGCTCAACCACGCGCTCC | 90 | 131 |
| 1201076 | 1104 | 1123 | 16895 | 16914 | TGCTCGATCCTCTCTGGTAA | 77 | 132 |
| 1201082 | 1233 | 1252 | 17024 | 17043 | GATACCGCCTCCCTCAAGCT | 47 | 133 |
| 1201088 | 1239 | 1258 | 17030 | 17049 | CAGGTGGATACCGCCTCCCT | 99 | 134 |
| 1201094 | 1310 | 1329 | 17101 | 17120 | CCAAGGGTATTGATTAGCCT | 16 | 135 |
| 1201100 | 1398 | 1417 | 17189 | 17208 | GCATTAGCAACGGCTCATGA | 63 | 136 |
| 1201106 | 1406 | 1425 | 17197 | 17216 | CTGGCCTGGCATTAGCAACG | 66 | 137 |
| 1201112 | 1474 | 1493 | 17265 | 17284 | TCAACCTGTTGCACTAAGTC | 23 | 138 |
| 1201118 | 1562 | 1581 | 17353 | 17372 | GGCATTAGTATACTGAGCTC | 49 | 139 |
| 1201124 | 1660 | 1679 | 17451 | 17470 | GTATCATGTGGCCTCCTAAC | 14 | 140 |
| 1201130 | 1744 | 1763 | 17535 | 17554 | GTTCTCGGTACACACAGAGC | 83 | 141 |
| 1201136 | 1833 | 1852 | 17624 | 17643 | CTAGCCAGAGGTTCAGTGTT | 46 | 142 |
| 1201142 | 1963 | 1982 | 17754 | 17773 | GCCACATATAGGGTCCTTTA | 7 | 66 |
| 1201143 | 1965 | 1984 | 17756 | 17775 | ATGCCACATATAGGGTCCTT | 10 | 143 |
| 1201149 | 2586 | 2605 | 18377 | 18396 | CCACGCAAAAGGGTTTCCCA | 36 | 144 |
| 1201155 | 2609 | 2628 | 18400 | 18419 | AGTGCACATTGTAAGCCTAA | 47 | 145 |
| 1201161 | N/A | N/A | 3556 | 3575 | TCCTCACTCGGCCCCCGCGG | 74 | 146 |
| 1201167 | N/A | N/A | 3596 | 3615 | CCGGCCGGGCACCCTTGCGC | 104 | 147 |
| 1201173 | N/A | N/A | 3693 | 3712 | CACCCGAGCGGAGACCAGCG | 94 | 148 |
| 1201179 | N/A | N/A | 3704 | 3723 | CCAAGCCGCCTCACCCGAGC | 61 | 149 |
| 1201185 | N/A | N/A | 3790 | 3809 | CCACCGACCTCCCTAACGGG | 101 | 150 |
| 1201191 | N/A | N/A | 3849 | 3868 | GCGATCGCCCGCTGGGCCGG | 95 | 151 |
| 1201198 | N/A | N/A | 3877 | 3896 | CGGCCCTCCCGGAGTTCCCT | 81 | 152 |
| 1201205 | N/A | N/A | 3984 | 4003 | TTCTGGGCCCCGATCTCGGC | 105 | 153 |
| 1201211 | N/A | N/A | 4072 | 4091 | CCCGGAACTCCCCCGGCGGG | 92 | 154 |
| 1201217 | N/A | N/A | 4083 | 4102 | GCACCGAGGCTCCCGGAACT | 78 | 155 |
| 1201223 | N/A | N/A | 4187 | 4206 | GGTGGCAACGGCCGCAAGGC | 87 | 156 |
| 1201229 | N/A | N/A | 4418 | 4437 | TGGTTGTTCCTTGGAGCCCC | 81 | 157 |
| 1201235 | N/A | N/A | 4606 | 4625 | TGTGACCGTGGTGGAATTGC | 35 | 158 |
| 1201241 | N/A | N/A | 5080 | 5099 | GGTGTGGAAGACTTGTGTTA | 35 | 159 |
| 1201247 | N/A | N/A | 5464 | 5483 | GCATCACCAGATTGCTTAAC | 49 | 160 |
| 1201253 | N/A | N/A | 5745 | 5764 | AGGTGCAGTTAATAACCCAC | 62 | 161 |
| 1201259 | N/A | N/A | 6542 | 6561 | GGCTAGTTGGTTGACAGCCA | 90 | 162 |
| 1201265 | N/A | N/A | 6925 | 6944 | CCCGTGATCAGGCTTCAGTG | 66 | 163 |
| 1201271 | N/A | N/A | 6987 | 7006 | CAGTCAGAGAGTGCCTAGCG | 51 | 164 |
| 1201277 | N/A | N/A | 7284 | 7303 | AGCTTAATTAGTTACATCGG | 18 | 165 |

TABLE 3-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201283 | N/A | N/A | 7435 | 7454 | CCCCGTTCATCTTATTCCCA | 44 | 166 |
| 1201289 | N/A | N/A | 9031 | 9050 | TCTCTTAGATTTTTGGACGG | 32 | 167 |
| 1201295 | N/A | N/A | 9851 | 9870 | GTGGGCACACTTAGCCACCC | 85 | 168 |
| 1201301 | N/A | N/A | 10127 | 10146 | GGTCTGGGACTTCCATAACC | 93 | 169 |
| 1201307 | N/A | N/A | 10592 | 10611 | GGTGGACTGCTAAGACTAGG | 52 | 170 |
| 1201313 | N/A | N/A | 10806 | 10825 | AGCTATATATAGGTGACCCA | 61 | 171 |
| 1201319 | N/A | N/A | 12109 | 12128 | AAGATTCTTGTTCAGCACGA | 53 | 172 |
| 1201325 | N/A | N/A | 13633 | 13652 | CCATTGTCATGGGACTCAAG | 49 | 173 |
| 1201331 | N/A | N/A | 13751 | 13770 | TAGTGGCCTAGTCCTCTGGC | 65 | 174 |
| 1201337 | N/A | N/A | 13947 | 13966 | GAGTTAAGGATCTATGAGCT | 60 | 175 |
| 1201343 | N/A | N/A | 14346 | 14365 | CGGGAGTGCAGGCTCCTTTA | 84 | 176 |
| 1201349 | N/A | N/A | 14639 | 14658 | CGTGGCCATACTGGCTGGGC | 83 | 177 |
| 1201355 | N/A | N/A | 14722 | 14741 | CTCCTCTTAATATGCGGGTC | 75 | 178 |
| 1201361 | N/A | N/A | 14823 | 14842 | ACATGACCATCTTATTCGGT | 55 | 179 |
| 1201367 | N/A | N/A | 15033 | 15052 | AACTAGGGCACCATCCCCTC | 78 | 180 |
| 1201373 | N/A | N/A | 15736 | 15755 | ACAGTACCTGCTGTACCCTA | 49 | 181 |

TABLE 4

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1200911 | 18 | 37 | 3111 | 3130 | CCAGCTCCCCGTTACATAAT | 90 | 182 |
| 1200917 | 99 | 118 | 3192 | 3211 | ACCGCCTGCGGGTGCCATCG | 112 | 183 |
| 1200923 | 107 | 126 | 3200 | 3219 | CAGTTGATACCGCCTGCGGG | 104 | 184 |
| 1200929 | 115 | 134 | 3208 | 3227 | ACTTGCATCAGTTGATACCG | 89 | 185 |
| 1200935 | 199 | 218 | 3292 | 3311 | CGAGGTTTAAGTTAAAGGGT | 86 | 186 |
| 1200941 | 224 | 243 | 3317 | 3336 | TCTGTGCCCCCGGCGGCGG | 80 | 187 |
| 1200947 | 243 | 262 | 3336 | 3355 | CGCGCGGCCCGGCGCACACT | 80 | 188 |
| 1200953 | 254 | 273 | 3347 | 3366 | GGACCAATTGCCGCGCGGCC | 81 | 189 |
| 1200959 | 342 | 361 | 3435 | 3454 | CGGAGGACAGGCGACGCGCG | 98 | 190 |
| 1200967 | 359 | 378 | 3452 | 3471 | GCTGTCAGCGACTGGCTCGG | 95 | 191 |
| 1200973 | 417 | 436 | 16208 | 16227 | TCGCCATAATGACTGCTCTG | 15* | 192 |
| 1200979 | 428 | 447 | 16219 | 16238 | GCAGCCAAGGTTCGCCATAA | 20* | 193 |
| 1200985 | 526 | 545 | 16317 | 16336 | GGGTATCGGCTGCCCCCAGT | 87* | 194 |
| 1200991 | 535 | 554 | 16326 | 16345 | CCCTGCCCCGGGTATCGGCT | 85 | 195 |
| 1200997 | 562 | 581 | 16353 | 16372 | GGTGGGTAGCGGTTGCCTCC | 90 | 196 |

TABLE 4 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201003 | 720 | 739 | 16511 | 16530 | TACTCGGCTTGTTCCACTGA | 78 | 197 |
| 1201009 | 730 | 749 | 16521 | 16540 | GTTTTTGGCTTACTCGGCTT | 41 | 198 |
| 1201015 | 800 | 819 | 16591 | 16610 | CAGCATGTAGCCGCCAAGGC | 69 | 199 |
| 1201021 | 830 | 849 | 16621 | 16640 | ATGTATGATGGGCCTGCTCA | 59 | 200 |
| 1201027 | 863 | 882 | 16654 | 16673 | ACGATAGTAACGGTCCTCAT | 41 | 201 |
| 1201033 | 879 | 898 | 16670 | 16689 | AACGGTGCATGTTTTCACGA | 67 | 202 |
| 1201039 | 906 | 925 | 16697 | 16716 | TGGGCCTGTAGTACACTTGG | 82 | 203 |
| 1201045 | 974 | 993 | 16765 | 16784 | CGTGTGCTGCTTGATTGTGA | 41 | 204 |
| 1201051 | 983 | 1002 | 16774 | 16793 | TGTGGTGACCGTGTGCTGCT | 83 | 205 |
| 1201057 | 1009 | 1028 | 16800 | 16819 | TCGGTGAAGTTCTCCCCCTT | 52 | 206 |
| 1201063 | 1038 | 1057 | 16829 | 16848 | CCACGCGCTCCATCATCTTA | 62 | 207 |
| 1201069 | 1050 | 1069 | 16841 | 16860 | ACATCTGCTCAACCACGCGC | 59 | 208 |
| 1201077 | 1105 | 1124 | 16896 | 16915 | ATGCTCGATCCTCTCTGGTA | 77 | 209 |
| 1201083 | 1234 | 1253 | 17025 | 17044 | GGATACCGCCTCCCTCAAGC | 26 | 210 |
| 1201089 | 1243 | 1262 | 17034 | 17053 | GCTGCAGGTGGATACCGCCT | 94 | 211 |
| 1201095 | 1311 | 1330 | 17102 | 17121 | GCCAAGGGTATTGATTAGCC | 9 | 212 |
| 1201101 | 1399 | 1418 | 17190 | 17209 | GGCATTAGCAACGGCTCATG | 40 | 213 |
| 1201107 | 1410 | 1429 | 17201 | 17220 | TTTACTGGCCTGGCATTAGC | 44 | 214 |
| 1201113 | 1480 | 1499 | 17271 | 17290 | TTAGCCTCAACCTGTTGCAC | 33 | 215 |
| 1201119 | 1563 | 1582 | 17354 | 17373 | GGGCATTAGTATACTGAGCT | 15 | 216 |
| 1201125 | 1722 | 1741 | 17513 | 17532 | ATGCTCCAGCGGGCTGAGCC | 110 | 217 |
| 1201131 | 1748 | 1767 | 17539 | 17558 | CCCAGTTCTCGGTACACACA | 41 | 218 |
| 1201137 | 1839 | 1858 | 17630 | 17649 | TGTCCTCTAGCCAGAGGTTC | 93 | 219 |
| 1201142 | 1963 | 1982 | 17754 | 17773 | GCCACATATAGGGTCCTTTA | 9 | 66 |
| 1201144 | 1967 | 1986 | 17758 | 17777 | GAATGCCACATATAGGGTCC | 18 | 220 |
| 1201150 | 2587 | 2606 | 18378 | 18397 | ACCACGCAAAAGGGTTTCCC | 45 | 221 |
| 1201156 | 2617 | 2636 | 18408 | 18427 | AACGATTCAGTGCACATTGT | 23 | 222 |
| 1201162 | N/A | N/A | 3557 | 3576 | GTCCTCACTCGGCCCCCGCG | 61 | 223 |
| 1201168 | N/A | N/A | 3599 | 3618 | CGCCCGGCCGGGCACCCTTG | 86 | 224 |
| 1201174 | N/A | N/A | 3694 | 3713 | TCACCCGAGCGGAGACCAGC | 81 | 225 |
| 1201180 | N/A | N/A | 3707 | 3726 | AAGCCAAGCCGCCTCACCCG | 77 | 226 |
| 1201186 | N/A | N/A | 3809 | 3828 | GCGCTGAGACACCCCGGCGC | 108 | 227 |
| 1201192 | N/A | N/A | 3850 | 3869 | AGCGATCGCCCGCTGGGCCG | 94 | 228 |
| 1201200 | N/A | N/A | 3878 | 3897 | GCGGCCCTCCCGGAGTTCCC | 72 | 229 |
| 1201206 | N/A | N/A | 3986 | 4005 | CGTTCTGGGCCCCGATCTCG | 53 | 230 |
| 1201212 | N/A | N/A | 4073 | 4092 | TCCCGGAACTCCCCCGGCGG | 92 | 231 |

TABLE 4 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201218 | N/A | N/A | 4120 | 4139 | CCGCCTCCCGGGAGGAACGC | 81 | 232 |
| 1201224 | N/A | N/A | 4193 | 4212 | CCAGGCGGTGGCAACGGCCG | 93 | 233 |
| 1201230 | N/A | N/A | 4425 | 4444 | CCGAGGCTGGTTGTTCCTTG | 94 | 234 |
| 1201236 | N/A | N/A | 4618 | 4637 | GGCGAGGATGGATGTGACCG | 59 | 235 |
| 1201242 | N/A | N/A | 5082 | 5101 | TCGGTGTGGAAGACTTGTGT | 43 | 236 |
| 1201248 | N/A | N/A | 5612 | 5631 | GGTGTTATACATTTAGGCTC | 20 | 237 |
| 1201254 | N/A | N/A | 6201 | 6220 | GCTAAACTAGATTTGTGCCT | 73 | 238 |
| 1201260 | N/A | N/A | 6543 | 6562 | TGGCTAGTTGGTTGACAGCC | 101 | 239 |
| 1201266 | N/A | N/A | 6935 | 6954 | GGAATTGGCACCCGTGATCA | 73 | 240 |
| 1201272 | N/A | N/A | 6988 | 7007 | CCAGTCAGAGAGTGCCTAGC | 81 | 241 |
| 1201278 | N/A | N/A | 7324 | 7343 | CACTAAAGCCTTCTAGCCCA | 66 | 242 |
| 1201284 | N/A | N/A | 7557 | 7576 | GGTGCACTTGACCTGCCAGG | 114 | 243 |
| 1201290 | N/A | N/A | 9317 | 9336 | AGTCCCTAAATCAGCTGTAG | 63 | 244 |
| 1201296 | N/A | N/A | 9852 | 9871 | GGTGGGCACACTTAGCCACC | 94 | 245 |
| 1201302 | N/A | N/A | 10140 | 10159 | TGAGAGTTGCCCGGGTCTGG | 77 | 246 |
| 1201308 | N/A | N/A | 10626 | 10645 | GATCAAATCTGTGGAGCCCC | 94 | 247 |
| 1201314 | N/A | N/A | 10807 | 10826 | CAGCTATATATAGGTGACCC | 64 | 248 |
| 1201320 | N/A | N/A | 13260 | 13279 | TTCCATGGTCTTGATGGCGA | 56 | 249 |
| 1201326 | N/A | N/A | 13697 | 13716 | GGTCAATACCTGTTTATTAC | 24 | 250 |
| 1201332 | N/A | N/A | 13752 | 13771 | GTAGTGGCCTAGTCCTCTGG | 85 | 251 |
| 1201338 | N/A | N/A | 13980 | 13999 | CGGGCTTTGAATGTGCCTCA | 77 | 252 |
| 1201344 | N/A | N/A | 14500 | 14519 | GGCTAAAGTTTGCTCAGTGG | 24 | 253 |
| 1201350 | N/A | N/A | 14676 | 14695 | AGTGAGGCTCCTTTGTACTC | 61 | 254 |
| 1201356 | N/A | N/A | 14723 | 14742 | TCTCCTCTTAATATGCGGGT | 64 | 255 |
| 1201362 | N/A | N/A | 14824 | 14843 | AACATGACCATCTTATTCGG | 73 | 256 |
| 1201368 | N/A | N/A | 15058 | 15077 | GCTACTCATACACCCCAGGA | 45 | 257 |
| 1201374 | N/A | N/A | 15737 | 15756 | AACAGTACCTGCTGTACCCT | 58 | 258 |

TABLE 5

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1200912 | 19 | 38 | 3112 | 3131 | TCCAGCTCCCCGTTACATAA | 77 | 259 |
| 1200918 | 100 | 119 | 3193 | 3212 | TACCGCCTGCGGGTGCCATC | 77 | 260 |
| 1200924 | 108 | 127 | 3201 | 3220 | TCAGTTGATACCGCCTGCGG | 87 | 261 |
| 1200930 | 116 | 135 | 3209 | 3228 | CACTTGCATCAGTTGATACC | 87 | 262 |

TABLE 5-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1200936 | 206 | 225 | 3299 | 3318 | GGCCGGCCGAGGTTTAAGTT | 96 | 263 |
| 1200942 | 231 | 250 | 3324 | 3343 | CGCACACTCTGTGCCCCCGG | 98 | 264 |
| 1200948 | 246 | 265 | 3339 | 3358 | TGCCGCGCGGCCCGGCGCAC | 89 | 265 |
| 1200954 | 255 | 274 | 3348 | 3367 | GGGACCAATTGCCGCGCGGC | 80 | 266 |
| 1200960 | 343 | 362 | 3436 | 3455 | TCGGAGGACAGGCGACGCGC | 113 | 267 |
| 1200968 | 361 | 380 | 3454 | 3473 | CGGCTGTCAGCGACTGGCTC | 90 | 268 |
| 1200974 | 418 | 437 | 16209 | 16228 | TTCGCCATAATGACTGCTCT | 17* | 269 |
| 1200980 | 429 | 448 | 16220 | 16239 | AGCAGCCAAGGTTCGCCATA | 23* | 270 |
| 1200986 | 527 | 546 | 16318 | 16337 | CGGGTATCGGCTGCCCCCAG | 69* | 271 |
| 1200992 | 536 | 555 | 16327 | 16346 | GCCCTGCCCCGGGTATCGGC | 97 | 272 |
| 1200998 | 563 | 582 | 16354 | 16373 | AGGTGGGTAGCGGTTGCCTC | 73 | 273 |
| 1201004 | 721 | 740 | 16512 | 16531 | TTACTCGGCTTGTTCCACTG | 49 | 274 |
| 1201010 | 731 | 750 | 16522 | 16541 | GGTTTTTGGCTTACTCGGCT | 11 | 275 |
| 1201016 | 801 | 820 | 16592 | 16611 | CCAGCATGTAGCCGCCAAGG | 50 | 276 |
| 1201022 | 836 | 855 | 16627 | 16646 | GCCGAAATGTATGATGGGCC | 86 | 277 |
| 1201028 | 864 | 883 | 16655 | 16674 | CACGATAGTAACGGTCCTCA | 49 | 278 |
| 1201034 | 882 | 901 | 16673 | 16692 | GGTAACGGTGCATGTTTTCA | 34 | 279 |
| 1201040 | 909 | 928 | 16700 | 16719 | CCATGGGCCTGTAGTACACT | 79 | 280 |
| 1201046 | 975 | 994 | 16766 | 16785 | CCGTGTGCTGCTTGATTGTG | 38 | 281 |
| 1201052 | 984 | 1003 | 16775 | 16794 | TTGTGGTGACCGTGTGCTGC | 63 | 282 |
| 1201058 | 1010 | 1029 | 16801 | 16820 | CTCGGTGAAGTTCTCCCCCT | 66 | 283 |
| 1201064 | 1040 | 1059 | 16831 | 16850 | AACCACGCGCTCCATCATCT | 41 | 284 |
| 1201070 | 1053 | 1072 | 16844 | 16863 | TACACATCTGCTCAACCACG | 45 | 285 |
| 1201078 | 1112 | 1131 | 16903 | 16922 | GAGGACCATGCTCGATCCTC | 77 | 286 |
| 1201084 | 1235 | 1254 | 17026 | 17045 | TGGATACCGCCTCCCTCAAG | 47 | 287 |
| 1201090 | 1304 | 1323 | 17095 | 17114 | GTATTGATTAGCCTATCCGG | 52 | 288 |
| 1201096 | 1312 | 1331 | 17103 | 17122 | TGCCAAGGGTATTGATTAGC | 21 | 289 |
| 1201102 | 1400 | 1419 | 17191 | 17210 | TGGCATTAGCAACGGCTCAT | 28 | 290 |
| 1201108 | 1418 | 1437 | 17209 | 17228 | GTTATACTTTTACTGGCCTG | 28 | 291 |
| 1201114 | 1555 | 1574 | 17346 | 17365 | GTATACTGAGCTCTAGCTGC | 67 | 292 |
| 1201120 | 1564 | 1583 | 17355 | 17374 | AGGGCATTAGTATACTGAGC | 4 | 293 |
| 1201126 | 1723 | 1742 | 17514 | 17533 | CATGCTCCAGCGGGCTGAGC | 104 | 294 |
| 1201132 | 1755 | 1774 | 17546 | 17565 | ACATCACCCCAGTTCTCGGT | 23 | 295 |
| 1201138 | 1846 | 1865 | 17637 | 17656 | GTGAATATGTCCTCTAGCCA | 12 | 296 |
| 1201142 | 1963 | 1982 | 17754 | 17773 | GCCACATATAGGGTCCTTTA | 11 | 66 |
| 1201145 | 1968 | 1987 | 17759 | 17778 | GGAATGCCACATATAGGGTC | 13 | 297 |

TABLE 5-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201151 | 2599 | 2618 | 18390 | 18409 | GTAAGCCTAAGGACCACGCA | 21 | 298 |
| 1201157 | 2652 | 2671 | 18443 | 18462 | CCTGTTAATGGTGTCCACTT | 11 | 299 |
| 1201163 | N/A | N/A | 3584 | 3603 | CCTTGCGCCTGGGACCCGAG | 76 | 300 |
| 1201169 | N/A | N/A | 3670 | 3689 | CCGGGCAGGCCCGAGACGCG | 79 | 301 |
| 1201175 | N/A | N/A | 3695 | 3714 | CTCACCCGAGCGGAGACCAG | 97 | 302 |
| 1201181 | N/A | N/A | 3709 | 3728 | CGAAGCCAAGCCGCCTCACC | 89 | 303 |
| 1201187 | N/A | N/A | 3841 | 3860 | CCGCTGGGCCGGACCCGCGC | 92 | 304 |
| 1201193 | N/A | N/A | 3852 | 3871 | CCAGCGATCGCCCGCTGGGC | 84 | 305 |
| 1201201 | N/A | N/A | 3882 | 3901 | GCTGGCGGCCCTCCCGGAGT | 73 | 306 |
| 1201207 | N/A | N/A | 4029 | 4048 | GCACCCTCTGGGCATCGCGG | 85 | 307 |
| 1201213 | N/A | N/A | 4074 | 4093 | CTCCCGGAACTCCCCCGGCG | 85 | 308 |
| 1201219 | N/A | N/A | 4158 | 4177 | CCTCGGAGAAGCTCAGGCGG | 110 | 309 |
| 1201225 | N/A | N/A | 4196 | 4215 | TCTCCAGGCGGTGGCAACGG | 92 | 310 |
| 1201231 | N/A | N/A | 4426 | 4445 | TCCGAGGCTGGTTGTTCCTT | 60 | 311 |
| 1201237 | N/A | N/A | 4634 | 4653 | GCTGTGGCTCTGCGATGGCG | 92 | 312 |
| 1201243 | N/A | N/A | 5235 | 5254 | GCAACCTTCCAGCAAGGGTT | 85 | 313 |
| 1201249 | N/A | N/A | 5614 | 5633 | CTGGTGTTATACATTTAGGC | 40 | 314 |
| 1201255 | N/A | N/A | 6219 | 6238 | ACAATCTGTTGTGGTTCAGC | 7 | 315 |
| 1201261 | N/A | N/A | 6546 | 6565 | GTTTGGCTAGTTGGTTGACA | 32 | 316 |
| 1201267 | N/A | N/A | 6939 | 6958 | TCAGGGAATTGGCACCCGTG | 77 | 317 |
| 1201273 | N/A | N/A | 7051 | 7070 | GGTCCATGATCAGAATTACC | 80 | 318 |
| 1201279 | N/A | N/A | 7325 | 7344 | GCACTAAAGCCTTCTAGCCC | 74 | 319 |
| 1201285 | N/A | N/A | 7559 | 7578 | AGGGTGCACTTGACCTGCCA | 74 | 320 |
| 1201291 | N/A | N/A | 9318 | 9337 | GAGTCCCTAAATCAGCTGTA | 46 | 321 |
| 1201297 | N/A | N/A | 9863 | 9882 | GCTAGTACACAGGTGGGCAC | 75 | 322 |
| 1201303 | N/A | N/A | 10144 | 10163 | GGAGTGAGAGTTGCCCGGGT | 95 | 323 |
| 1201309 | N/A | N/A | 10650 | 10669 | GGTGGGCTTAAGGACCAAAA | 87 | 324 |
| 1201315 | N/A | N/A | 11775 | 11794 | GATTTGGAACCTGCATGGCT | 73 | 325 |
| 1201321 | N/A | N/A | 13443 | 13462 | AGCCTACGAAAACCAACGGC | 95 | 326 |
| 1201327 | N/A | N/A | 13703 | 13722 | GGTAATGGTCAATACCTGTT | 46 | 327 |
| 1201333 | N/A | N/A | 13754 | 13773 | AAGTAGTGGCCTAGTCCTCT | 61 | 328 |
| 1201339 | N/A | N/A | 13984 | 14003 | GAGTCGGGCTTTGAATGTGC | 37 | 329 |
| 1201345 | N/A | N/A | 14618 | 14637 | CCATGTAACCTGGTTCAGGC | 47 | 330 |
| 1201351 | N/A | N/A | 14708 | 14727 | CGGGTCACATCATGCCACTT | 64 | 331 |
| 1201357 | N/A | N/A | 14814 | 14833 | TCTTATTCGGTGCTTCCATC | 36 | 332 |
| 1201363 | N/A | N/A | 14882 | 14901 | ATCTCAGTAGCTCTACCTTG | 41 | 333 |

TABLE 5-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201369 | N/A | N/A | 15107 | 15126 | CCCTGATGTAGTCCCCACAA | 95 | 334 |
| 1201375 | N/A | N/A | 15789 | 15808 | GGGCACTTAGCTCCAAGAGC | 52 | 335 |

TABLE 6

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1200913 | 46 | 65 | 3139 | 3158 | TCTTTAATTGGAAATTCGGC | 97 | 336 |
| 1200919 | 101 | 120 | 3194 | 3213 | ATACCGCCTGCGGGTGCCAT | 80 | 337 |
| 1200925 | 110 | 129 | 3203 | 3222 | CATCAGTTGATACCGCCTGC | 90 | 338 |
| 1200931 | 128 | 147 | 3221 | 3240 | GATTCGCTTGAACACTTGCA | 103 | 339 |
| 1200937 | 208 | 227 | 3301 | 3320 | GCGGCCGGCCGAGGTTTAAG | 104 | 340 |
| 1200943 | 234 | 253 | 3327 | 3346 | CGGCGCACACTCTGTGCCCC | 101 | 341 |
| 1200949 | 248 | 267 | 3341 | 3360 | ATTGCCGCGCGGCCCGGCGC | 97 | 342 |
| 1200955 | 278 | 297 | 3371 | 3390 | GCTCGCGGGCGGAGGTCGGC | 80 | 343 |
| 1200963 | 345 | 364 | 3438 | 3457 | GCTCGGAGGACAGGCGACGC | 131 | 344 |
| 1200969 | 364 | 383 | 3457 | 3476 | CCGCGGCTGTCAGCGACTGG | 93 | 345 |
| 1200975 | 419 | 438 | 16210 | 16229 | GTTCGCCATAATGACTGCTC | 21* | 346 |
| 1200981 | 432 | 451 | 16223 | 16242 | TCCAGCAGCCAAGGTTCGCC | 22* | 347 |
| 1200987 | 528 | 547 | 16319 | 16338 | CCGGGTATCGGCTGCCCCCA | 100* | 348 |
| 1200993 | 537 | 556 | 16328 | 16347 | TGCCCTGCCCCGGGTATCGG | 67 | 349 |
| 1200999 | 564 | 583 | 16355 | 16374 | GAGGTGGGTAGCGGTTGCCT | 83 | 350 |
| 1201005 | 723 | 742 | 16514 | 16533 | GCTTACTCGGCTTGTTCCAC | 18 | 351 |
| 1201011 | 732 | 751 | 16523 | 16542 | TGGTTTTTGGCTTACTCGGC | 19 | 352 |
| 1201017 | 803 | 822 | 16594 | 16613 | TCCCAGCATGTAGCCGCCAA | 83 | 353 |
| 1201023 | 837 | 856 | 16628 | 16647 | TGCCGAAATGTATGATGGGC | 84 | 354 |
| 1201029 | 865 | 884 | 16656 | 16675 | TCACGATAGTAACGGTCCTC | 47 | 355 |
| 1201035 | 883 | 902 | 16674 | 16693 | GGGTAACGGTGCATGTTTTC | 42 | 356 |
| 1201041 | 911 | 930 | 16702 | 16721 | ATCCATGGGCCTGTAGTACA | 77 | 357 |
| 1201047 | 978 | 997 | 16769 | 16788 | TGACCGTGTGCTGCTTGATT | 46 | 358 |
| 1201053 | 987 | 1006 | 16778 | 16797 | TGGTTGTGGTGACCGTGTGC | 78 | 359 |
| 1201059 | 1011 | 1030 | 16802 | 16821 | TCTCGGTGAAGTTCTCCCCC | 58 | 360 |
| 1201065 | 1043 | 1062 | 16834 | 16853 | CTCAACCACGCGCTCCATCA | 36 | 361 |
| 1201071 | 1059 | 1078 | 16850 | 16869 | GGGTGATACACATCTGCTCA | 93 | 362 |
| 1201079 | 1114 | 1133 | 16905 | 16924 | AAGAGGACCATGCTCGATCC | 84 | 363 |
| 1201085 | 1236 | 1255 | 17027 | 17046 | GTGGATACCGCCTCCCTCAA | 61 | 364 |

TABLE 6 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201091 | 1305 | 1324 | 17096 | 17115 | GGTATTGATTAGCCTATCCG | 27 | 365 |
| 1201097 | 1316 | 1335 | 17107 | 17126 | TCAGTGCCAAGGGTATTGAT | 76 | 366 |
| 1201103 | 1401 | 1420 | 17192 | 17211 | CTGGCATTAGCAACGGCTCA | 52 | 367 |
| 1201109 | 1421 | 1440 | 17212 | 17231 | GCTGTTATACTTTTACTGGC | 19 | 368 |
| 1201115 | 1556 | 1575 | 17347 | 17366 | AGTATACTGAGCTCTAGCTG | 67 | 369 |
| 1201121 | 1635 | 1654 | 17426 | 17445 | TGGCAGAAATGTTGTCGGGT | 13 | 370 |
| 1201127 | 1729 | 1748 | 17520 | 17539 | AGAGCTCATGCTCCAGCGGG | 95 | 371 |
| 1201133 | 1756 | 1775 | 17547 | 17566 | AACATCACCCCAGTTCTCGG | 23 | 372 |
| 1201139 | 1938 | 1957 | 17729 | 17748 | CTAAAATGGGAGGTTGCCTC | 98 | 373 |
| 1201142 | 1963 | 1982 | 17754 | 17773 | GCCACATATAGGGTCCTTTA | 11 | 66 |
| 1201146 | 1998 | 2017 | 17789 | 17808 | GCTGCCTTAATTACCTATAG | 46 | 374 |
| 1201152 | 2600 | 2619 | 18391 | 18410 | TGTAAGCCTAAGGACCACGC | 27 | 375 |
| 1201158 | 2653 | 2672 | 18444 | 18463 | ACCTGTTAATGGTGTCCACT | 24 | 376 |
| 1201164 | N/A | N/A | 3585 | 3604 | CCCTTGCGCCTGGGACCCGA | 85 | 377 |
| 1201170 | N/A | N/A | 3686 | 3705 | GCGGAGACCAGCGCAGCCGG | 93 | 378 |
| 1201176 | N/A | N/A | 3698 | 3717 | CGCCTCACCCGAGCGGAGAC | 101 | 379 |
| 1201182 | N/A | N/A | 3710 | 3729 | GCGAAGCCAAGCCGCCTCAC | 82 | 380 |
| 1201188 | N/A | N/A | 3842 | 3861 | CCCGCTGGGCCGGACCCGCG | 100 | 381 |
| 1201194 | N/A | N/A | 3853 | 3872 | GCCAGCGATCGCCCGCTGGG | 110 | 382 |
| 1201202 | N/A | N/A | 3895 | 3914 | CCCTGCGGAGCCCGCTGGCG | 107 | 383 |
| 1201208 | N/A | N/A | 4031 | 4050 | AAGCACCCTCTGGGCATCGC | 70 | 384 |
| 1201214 | N/A | N/A | 4079 | 4098 | CGAGGCTCCCGGAACTCCCC | 79 | 385 |
| 1201220 | N/A | N/A | 4163 | 4182 | GCCCCCCTCGGAGAAGCTCA | 77 | 386 |
| 1201226 | N/A | N/A | 4203 | 4222 | GGCCGCTTCTCCAGGCGGTG | 106 | 387 |
| 1201232 | N/A | N/A | 4427 | 4446 | ATCCGAGGCTGGTTGTTCCT | 52 | 388 |
| 1201238 | N/A | N/A | 4640 | 4659 | CGGAGAGCTGTGGCTCTGCG | 93 | 389 |
| 1201244 | N/A | N/A | 5236 | 5255 | GGCAACCTTCCAGCAAGGGT | 58 | 390 |
| 1201250 | N/A | N/A | 5622 | 5641 | CTACTGCCCTGGTGTTATAC | 52 | 391 |
| 1201256 | N/A | N/A | 6339 | 6358 | ATGCACCCGAGTGGCCTCTG | 80 | 392 |
| 1201262 | N/A | N/A | 6547 | 6566 | GGTTTGGCTAGTTGGTTGAC | 26 | 393 |
| 1201268 | N/A | N/A | 6941 | 6960 | TCTCAGGGAATTGGCACCCG | 71 | 394 |
| 1201274 | N/A | N/A | 7231 | 7250 | ACCCCATAATGTCCCTTGTC | 82 | 395 |
| 1201280 | N/A | N/A | 7326 | 7345 | GGCACTAAAGCCTTCTAGCC | 102 | 396 |
| 1201286 | N/A | N/A | 7560 | 7579 | AAGGGTGCACTTGACCTGCC | 101 | 397 |
| 1201292 | N/A | N/A | 9490 | 9509 | GCATTCCCATTAATGTGGTG | 41 | 398 |
| 1201298 | N/A | N/A | 9919 | 9938 | GTCTTCACCTGAGATGTAGT | 45 | 399 |

TABLE 6 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201304 | N/A | N/A | 10147 | 10166 | GGAGGAGTGAGAGTTGCCCG | 87 | 400 |
| 1201310 | N/A | N/A | 10662 | 10681 | GATACTTAGCTTGGTGGGCT | 53 | 401 |
| 1201316 | N/A | N/A | 11827 | 11846 | GCTTATCAGGATAGCACAAA | 57 | 402 |
| 1201322 | N/A | N/A | 13457 | 13476 | TGGGACTGAAGGTCAGCCTA | 109 | 403 |
| 1201328 | N/A | N/A | 13746 | 13765 | GCCTAGTCCTCTGGCATATT | 105 | 404 |
| 1201334 | N/A | N/A | 13758 | 13777 | AGTCAAGTAGTGGCCTAGTC | 46 | 405 |
| 1201340 | N/A | N/A | 13995 | 14014 | GGAATGACACTGAGTCGGGC | 58 | 406 |
| 1201346 | N/A | N/A | 14619 | 14638 | CCCATGTAACCTGGTTCAGG | 78 | 407 |
| 1201352 | N/A | N/A | 14718 | 14737 | TCTTAATATGCGGGTCACAT | 61 | 408 |
| 1201358 | N/A | N/A | 14815 | 14834 | ATCTTATTCGGTGCTTCCAT | 44 | 409 |
| 1201364 | N/A | N/A | 14905 | 14924 | GCATACATTGGATCTATCAG | 22 | 410 |
| 1201370 | N/A | N/A | 15181 | 15200 | GGTCATGCCAGTTAGGGTTT | 22 | 411 |
| 1201376 | N/A | N/A | 15796 | 15815 | TTACCCTGGGCACTTAGCTC | 85 | 412 |

TABLE 7

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1200914 | 91 | 110 | 3184 | 3203 | CGGGTGCCATCGCTCCCTGA | 68 | 413 |
| 1200920 | 102 | 121 | 3195 | 3214 | GATACCGCCTGCGGGTGCCA | 77 | 414 |
| 1200926 | 111 | 130 | 3204 | 3223 | GCATCAGTTGATACCGCCTG | 103 | 415 |
| 1200932 | 138 | 157 | 3231 | 3250 | AACGAGTTGAGATTCGCTTG | 96 | 416 |
| 1200938 | 209 | 228 | 3302 | 3321 | GGCGGCCGGCCGAGGTTTAA | 89 | 417 |
| 1200944 | 235 | 254 | 3328 | 3347 | CCGGCGCACACTCTGTGCCC | 96 | 418 |
| 1200950 | 250 | 269 | 3343 | 3362 | CAATTGCCGCGCGGCCCGGC | 76 | 419 |
| 1200956 | 279 | 298 | 3372 | 3391 | CGCTCGCGGGCGGAGGTCGG | 116 | 420 |
| 1200964 | 352 | 371 | 3445 | 3464 | GCGACTGGCTCGGAGGACAG | 107 | 421 |
| 1200970 | 366 | 385 | 3459 | 3478 | CGCCGCGGCTGTCAGCGACT | 99 | 422 |
| 1200976 | 421 | 440 | 16212 | 16231 | AGGTTCGCCATAATGACTGC | 25* | 423 |
| 1200982 | 485 | 504 | 16276 | 16295 | GCGCTTCTTGCAGAGGCCCA | 42* | 424 |
| 1200988 | 529 | 548 | 16320 | 16339 | CCCGGGTATCGGCTGCCCCC | 82* | 425 |
| 1200994 | 559 | 578 | 16350 | 16369 | GGGTAGCGGTTGCCTCCAGG | 99 | 426 |
| 1201000 | 568 | 587 | 16359 | 16378 | CCCTGAGGTGGGTAGCGGTT | 95 | 427 |
| 1201006 | 724 | 743 | 16515 | 16534 | GGCTTACTCGGCTTGTTCCA | 30 | 428 |
| 1201012 | 796 | 815 | 16587 | 16606 | ATGTAGCCGCCAAGGCCCCC | 97 | 429 |
| 1201018 | 805 | 824 | 16596 | 16615 | CTTCCCAGCATGTAGCCGCC | 83 | 430 |

TABLE 7 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201024 | 850 | 869 | 16641 | 16660 | TCCTCATAGTCACTGCCGAA | 60 | 431 |
| 1201030 | 866 | 885 | 16657 | 16676 | TTCACGATAGTAACGGTCCT | 59 | 432 |
| 1201036 | 901 | 920 | 16692 | 16711 | CTGTAGTACACTTGGTTGGG | 35 | 433 |
| 1201042 | 916 | 935 | 16707 | 16726 | TACTCATCCATGGGCCTGTA | 75 | 434 |
| 1201048 | 980 | 999 | 16771 | 16790 | GGTGACCGTGTGCTGCTTGA | 46 | 435 |
| 1201054 | 998 | 1017 | 16789 | 16808 | CTCCCCCTTGGTGGTTGTGG | 73 | 436 |
| 1201060 | 1013 | 1032 | 16804 | 16823 | GGTCTCGGTGAAGTTCTCCC | 93 | 437 |
| 1201066 | 1045 | 1064 | 16836 | 16855 | TGCTCAACCACGCGCTCCAT | 72 | 438 |
| 1201072 | 1089 | 1108 | 16880 | 16899 | GGTAATAGGCCTGAGATTCC | 25 | 439 |
| 1201080 | 1118 | 1137 | 16909 | 16928 | GGAGAAGAGGACCATGCTCG | 88 | 440 |
| 1201086 | 1237 | 1256 | 17028 | 17047 | GGTGGATACCGCCTCCCTCA | 95 | 441 |
| 1201092 | 1306 | 1325 | 17097 | 17116 | GGGTATTGATTAGCCTATCC | 32 | 442 |
| 1201098 | 1392 | 1411 | 17183 | 17202 | GCAACGGCTCATGATGAACT | 18 | 443 |
| 1201104 | 1402 | 1421 | 17193 | 17212 | CCTGGCATTAGCAACGGCTC | 74 | 444 |
| 1201110 | 1446 | 1465 | 17237 | 17256 | AGTCCAGATTAACCAATGGT | 27 | 445 |
| 1201116 | 1557 | 1576 | 17348 | 17367 | TAGTATACTGAGCTCTAGCT | 35 | 446 |
| 1201122 | 1637 | 1656 | 17428 | 17447 | CCTGGCAGAAATGTTGTCGG | 57 | 447 |
| 1201128 | 1739 | 1758 | 17530 | 17549 | CGGTACACACAGAGCTCATG | 50 | 448 |
| 1201134 | 1781 | 1800 | 17572 | 17591 | GTGTAGCCCATACTGTGAAA | 22 | 449 |
| 1201140 | 1954 | 1973 | 17745 | 17764 | AGGGTCCTTTAAACATCTAA | 29 | 450 |
| 1201142 | 1963 | 1982 | 17754 | 17773 | GCCACATATAGGGTCCTTTA | 8 | 66 |
| 1201147 | 2120 | 2139 | 17911 | 17930 | ATCCTCTATGATGATGGTGC | 74 | 451 |
| 1201153 | 2601 | 2620 | 18392 | 18411 | TTGTAAGCCTAAGGACCACG | 34 | 452 |
| 1201159 | 2656 | 2675 | 18447 | 18466 | AAGACCTGTTAATGGTGTCC | 33 | 453 |
| 1201165 | N/A | N/A | 3589 | 3608 | GGCACCCTTGCGCCTGGGAC | 79 | 454 |
| 1201171 | N/A | N/A | 3687 | 3706 | AGCGGAGACCAGCGCAGCCG | 82 | 455 |
| 1201177 | N/A | N/A | 3699 | 3718 | CCGCCTCACCCGAGCGGAGA | 98 | 456 |
| 1201183 | N/A | N/A | 3712 | 3731 | AAGCGAAGCCAAGCCGCCTC | 92 | 457 |
| 1201189 | N/A | N/A | 3845 | 3864 | TCGCCCGCTGGGCCGGACCC | 67 | 458 |
| 1201195 | N/A | N/A | 3871 | 3890 | TCCCGGAGTTCCCTGGGCGC | 101 | 459 |
| 1201203 | N/A | N/A | 3898 | 3917 | GCGCCCTGCGGAGCCCGCTG | 93 | 460 |
| 1201209 | N/A | N/A | 4070 | 4089 | CGGAACTCCCCCGGCGGGCG | 66 | 461 |
| 1201215 | N/A | N/A | 4080 | 4099 | CCGAGGCTCCCGGAACTCCC | 119 | 462 |
| 1201221 | N/A | N/A | 4164 | 4183 | AGCCCCCCTCGGAGAAGCTC | 78 | 463 |
| 1201227 | N/A | N/A | 4205 | 4224 | TGGGCCGCTTCTCCAGGCGG | 71 | 464 |
| 1201233 | N/A | N/A | 4452 | 4471 | GGAGACCGGTGACCCAAGGG | 52 | 465 |

TABLE 7-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201239 | N/A | N/A | 4720 | 4739 | CGCGGCCATGAAGATCCTCA | 79 | 466 |
| 1201245 | N/A | N/A | 5242 | 5261 | GTTTTGGGCAACCTTCCAGC | 50 | 467 |
| 1201251 | N/A | N/A | 5743 | 5762 | GTGCAGTTAATAACCCACTT | 42 | 468 |
| 1201257 | N/A | N/A | 6343 | 6362 | ACAGATGCACCCGAGTGGCC | 67 | 469 |
| 1201263 | N/A | N/A | 6640 | 6659 | GTGGATATAGTTGCCTTGGA | 19 | 470 |
| 1201269 | N/A | N/A | 6942 | 6961 | TTCTCAGGGAATTGGCACCC | 69 | 471 |
| 1201275 | N/A | N/A | 7239 | 7258 | CGACCTTCACCCCATAATGT | 72 | 472 |
| 1201281 | N/A | N/A | 7327 | 7346 | AGGCACTAAAGCCTTCTAGC | 89 | 473 |
| 1201287 | N/A | N/A | 8977 | 8996 | GACTTACACTTCACTTAGAC | 68 | 474 |
| 1201293 | N/A | N/A | 9691 | 9710 | GCTCTATTAATAGGTTAGGA | 7 | 475 |
| 1201299 | N/A | N/A | 10074 | 10093 | GGACAAACTGGTGGAGGGTC | 75 | 476 |
| 1201305 | N/A | N/A | 10229 | 10248 | GGAGTCCATGCAGCTAGCAG | 62 | 477 |
| 1201311 | N/A | N/A | 10795 | 10814 | GGTGACCCACAACACATTAT | 84 | 478 |
| 1201317 | N/A | N/A | 11828 | 11847 | CGCTTATCAGGATAGCACAA | 63 | 479 |
| 1201323 | N/A | N/A | 13538 | 13557 | GCAATTAGTGTGATCATGCA | 58 | 480 |
| 1201329 | N/A | N/A | 13749 | 13768 | GTGGCCTAGTCCTCTGGCAT | 80 | 481 |
| 1201335 | N/A | N/A | 13764 | 13783 | GTCACCAGTCAAGTAGTGGC | 97 | 482 |
| 1201341 | N/A | N/A | 13997 | 14016 | AGGGAATGACACTGAGTCGG | 69 | 483 |
| 1201347 | N/A | N/A | 14623 | 14642 | GGGCCCCATGTAACCTGGTT | 86 | 484 |
| 1201353 | N/A | N/A | 14719 | 14738 | CTCTTAATATGCGGGTCACA | 47 | 485 |
| 1201359 | N/A | N/A | 14817 | 14836 | CCATCTTATTCGGTGCTTCC | 32 | 486 |
| 1201365 | N/A | N/A | 14908 | 14927 | CCAGCATACATTGGATCTAT | 30 | 487 |
| 1201371 | N/A | N/A | 15188 | 15207 | GTACTCAGGTCATGCCAGTT | 29 | 488 |
| 1201377 | N/A | N/A | 16166 | 16185 | GAGTCCCATATTTATGTTGA | 84 | 489 |

TABLE 8

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 11 | 66 |
| 1238115 | 38 | 57 | 3131 | 3150 | TGGAAATTCGGCCCAAAGCT | 97 | 490 |
| 1238137 | 70 | 89 | 3163 | 3182 | GTGGCTCATTGACTGTAAAA | 112 | 491 |
| 1238159 | 148 | 167 | 3241 | 3260 | CACCGGAAAAAACGAGTTGA | 101 | 492 |
| 1238181 | 607 | 626 | 16398 | 16417 | CCCCAGCCACCACCATGAGG | 58 | 493 |
|  | 631 | 650 | 16422 | 16441 |  |  |  |
|  | 679 | 698 | 16470 | 16489 |  |  |  |
| 1238203 | 742 | 761 | 16533 | 16552 | TGCTTCATGTTGGTTTTTGG | 18 | 494 |

TABLE 8 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238225 | 1183 | 1202 | 16974 | 16993 | GAAGACCTTCCTCATCCCAC | 84 | 495 |
| 1238247 | 1358 | 1377 | 17149 | 17168 | TTGACCAGCATCTCAGGTCT | 107 | 496 |
| 1238269 | 1497 | 1516 | 17288 | 17307 | CTGTTCTGAGATTTGTTTTA | 25 | 497 |
| 1238291 | 1658 | 1677 | 17449 | 17468 | ATCATGTGGCCTCCTAACAA | 30 | 498 |
| 1238313 | 1801 | 1820 | 17592 | 17611 | ACTCTTGTTGAACAGCTGCT | 13 | 499 |
| 1238335 | 1830 | 1849 | 17621 | 17640 | GCCAGAGGTTCAGTGTTGTG | 19 | 500 |
| 1238357 | 1874 | 1893 | 17665 | 17684 | TTTCATATATGTTACAGTTA | 34 | 501 |
| 1238379 | 1910 | 1929 | 17701 | 17720 | CCATTCCCAAACATTTGATT | 87 | 502 |
| 1238401 | 1994 | 2013 | 17785 | 17804 | CCTTAATTACCTATAGTTTA | 34 | 503 |
| 1238423 | 2030 | 2049 | 17821 | 17840 | CCTTCAGTGTCTAGAAGGCA | 92 | 504 |
| 1238445 | 2080 | 2099 | 17871 | 17890 | TGTATGTCAAAATCATTCTG | 23 | 505 |
| 1238467 | 2115 | 2134 | 17906 | 17925 | CTATGATGATGGTGCTTTCA | 18 | 506 |
| 1238489 | 2145 | 2164 | 17936 | 17955 | ACACTGACCATTTTTAATT | 46 | 507 |
| 1238511 | 2173 | 2192 | 17964 | 17983 | AAGAAATGCAAGCAGTTCTT | 54 | 508 |
| 1238533 | 2234 | 2253 | 18025 | 18044 | CAATTACAGAAACTATGAAC | 86 | 509 |
| 1238555 | 2265 | 2284 | 18056 | 18075 | AGATTGTCTCCCTATTCTTT | 29 | 510 |
| 1238577 | 2298 | 2317 | 18089 | 18108 | TATTTCTGTCATCTCCAACC | 33 | 511 |
| 1238599 | 2322 | 2341 | 18113 | 18132 | TCTTTTTCCACTTCAAATCA | 55 | 512 |
| 1238621 | 2367 | 2386 | 18158 | 18177 | AACAATTCAGGGAATAATTT | 82 | 513 |
| 1238643 | 2405 | 2424 | 18196 | 18215 | GCAGAAAAGTAATACATATC | 25 | 514 |
| 1238665 | 2510 | 2529 | 18301 | 18320 | ACTGCTCTAAACAAAACTCC | 76 | 515 |
| 1238687 | 2566 | 2585 | 18357 | 18376 | CATATTAAGTATTCAGTACC | 61 | 516 |
| 1238709 | 2710 | 2729 | 18501 | 18520 | ACAAGAACATGCAAAGTTAC | 67 | 517 |
| 1238731 | N/A | N/A | 4714 | 4733 | CATGAAGATCCTCATCATTA | 72 | 518 |
| 1238753 | N/A | N/A | 4813 | 4832 | CTACCAGGAGTTTTCCCTAA | 66 | 519 |
| 1238775 | N/A | N/A | 4851 | 4870 | TTTTGATAATTATATTTGTA | 78 | 520 |
| 1238797 | N/A | N/A | 4892 | 4911 | CCAGAAGTTAACATATTTA | 17 | 521 |
| 1238819 | N/A | N/A | 4959 | 4978 | AAAATTGCTCCTTTCCACTG | 54 | 522 |
| 1238841 | N/A | N/A | 5009 | 5028 | TACTGGTTAGCTTTTTTCA | 41 | 523 |
| 1238863 | N/A | N/A | 5076 | 5095 | TGGAAGACTTGTGTTAGATA | 2 | 524 |
| 1238885 | N/A | N/A | 5119 | 5138 | TTTGCCATTTATCTATTATA | 37 | 525 |
| 1238907 | N/A | N/A | 5164 | 5183 | CAAACATGCTCTAATTTGCA | 49 | 526 |
| 1238929 | N/A | N/A | 5303 | 5322 | TGCAGAACCATCTTTGTGAC | 73 | 527 |
| 1238951 | N/A | N/A | 5414 | 5433 | CAATAACTCATACATACAGA | 57 | 528 |
| 1238973 | N/A | N/A | 5518 | 5537 | GCAGGTAAGTTCTCAGGAGT | 19 | 529 |
| 1238995 | N/A | N/A | 5639 | 5658 | TGTCATAATTTTCTTAGCTA | 16 | 530 |

TABLE 8 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239017 | N/A | N/A | 5691 | 5710 | GGCTCCAAAATCATGATTTT | 81 | 531 |
| 1239039 | N/A | N/A | 5736 | 5755 | TAATAACCCACTTTTTTACT | 93 | 532 |
| 1239061 | N/A | N/A | 5846 | 5865 | ACCAAAGGAAAATTAAGATC | 66 | 533 |
| 1239083 | N/A | N/A | 5982 | 6001 | GCTAAAAATCTTTTATTCTA | 85 | 534 |
| 1239105 | N/A | N/A | 6290 | 6309 | TGACCCTCATTTTCTGTGAC | 57 | 535 |
| 1239127 | N/A | N/A | 6425 | 6444 | TAATTCTAAAAATCTGTGGC | 58 | 536 |
| 1239149 | N/A | N/A | 6502 | 6521 | CAGAAACTTCTGTTATGTTA | 26 | 537 |
| 1239171 | N/A | N/A | 6689 | 6708 | TGGGTTAGATACAGACATGT | 40 | 538 |
| 1239193 | N/A | N/A | 6856 | 6875 | AGGATTACCTCCCTTAAAGT | 80 | 539 |
| 1239215 | N/A | N/A | 7199 | 7218 | AGTAAATTCCCTTGTTATAT | 65 | 540 |
| 1239237 | N/A | N/A | 7621 | 7640 | CATTATGAAATTATACTCAA | 95 | 541 |
| 1239259 | N/A | N/A | 8160 | 8179 | CTATCTTTCTATTTGTGTCT | 28 | 542 |
| 1239281 | N/A | N/A | 8330 | 8349 | TTAGATCTGAAACGAGACAA | 81 | 543 |
| 1239303 | N/A | N/A | 8642 | 8661 | GAAGCAAATTCAACAGCTCA | 87 | 544 |
| 1239325 | N/A | N/A | 8982 | 9001 | CATCAGACTTACACTTCACT | 60 | 545 |
| 1239347 | N/A | N/A | 9355 | 9374 | GGTGGTAGTTTTTCAAATCA | 18 | 546 |
| 1239369 | N/A | N/A | 9565 | 9584 | GGATAGTCTCTTTCCATCAT | 37 | 547 |
| 1239391 | N/A | N/A | 9879 | 9898 | AGGGTCAAAATTCAATGCTA | 42 | 548 |
| 1239413 | N/A | N/A | 10678 | 10697 | ACACAGTTTTGAATAAGATA | 76 | 549 |
| 1239435 | N/A | N/A | 10781 | 10800 | CATTATTGTGCCACCAAGCC | 86 | 550 |
| 1239457 | N/A | N/A | 12411 | 12430 | TTCTTTGCAGGGATATGCAA | 91 | 551 |
| 1239479 | N/A | N/A | 13523 | 13542 | ATGCACATAGAAAATCCAAC | 66 | 552 |
| 1239501 | N/A | N/A | 13736 | 13755 | CTGGCATATTTCAAGATATC | 63 | 553 |
| 1239523 | N/A | N/A | 14136 | 14155 | TAGTATTTTGACAATGGCC | 29 | 554 |
| 1239545 | N/A | N/A | 14368 | 14387 | TGCTTATTATTCATGTTCTC | 36 | 555 |
| 1239567 | N/A | N/A | 14697 | 14716 | ATGCCACTTCCCTTGTCCCT | 67 | 556 |
| 1239589 | N/A | N/A | 14920 | 14939 | GAATTTCTCTCCCAGCATA | 73 | 557 |
| 1239611 | N/A | N/A | 15212 | 15231 | TTGAAAGTTACAAGCAGAGT | 52 | 558 |
| 1239633 | N/A | N/A | 15334 | 15353 | AACTGGATAATATTCATAAA | 84 | 559 |
| 1239655 | N/A | N/A | 15411 | 15430 | CCTTTATCACCCAATTAGCT | 71 | 560 |
| 1239677 | N/A | N/A | 15489 | 15508 | TTTTAGTACATTTAATGAAA | 92 | 561 |
| 1239699 | N/A | N/A | 15672 | 15691 | TATAATGGCATATACTGGAA | 58 | 562 |
| 1239721 | N/A | N/A | 15738 | 15757 | AAACAGTACCTGCTGTACCC | 76 | 563 |
| 1239743 | N/A | N/A | 15823 | 15842 | AATCTCTTTTCAAATTAAAG | 83 | 564 |
| 1239765 | N/A | N/A | 15854 | 15873 | CCTTTGGAGAATGTACATTC | 41 | 565 |
| 1239787 | N/A | N/A | 15913 | 15932 | TTCTAATTTTGTACCAAAA | 63 | 566 |

TABLE 9

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 6 | 66 |
| 1238116 | 39 | 58 | 3132 | 3151 | TTGGAAATTCGGCCCAAAGC | 79 | 567 |
| 1238138 | 71 | 90 | 3164 | 3183 | CGTGGCTCATTGACTGTAAA | 77 | 568 |
| 1238160 | 150 | 169 | 3243 | 3262 | GTCACCGGAAAAAACGAGTT | 109 | 569 |
| 1238182 | 608 632 | 627 651 | 16399 16423 | 16418 16442 | CCCCCAGCCACCACCATGAG | 75 | 570 |
| 1238204 | 747 | 766 | 16538 | 16557 | CCATGTGCTTCATGTTGGTT | 61 | 571 |
| 1238226 | 1184 | 1203 | 16975 | 16994 | GGAAGACCTTCCTCATCCCA | 85 | 572 |
| 1238248 | 1359 | 1378 | 17150 | 17169 | CTTGACCAGCATCTCAGGTC | 84 | 573 |
| 1238270 | 1514 | 1533 | 17305 | 17324 | GGCAAAGGTATTTCAGACTG | 8 | 574 |
| 1238292 | 1659 | 1678 | 17450 | 17469 | TATCATGTGGCCTCCTAACA | 40 | 575 |
| 1238314 | 1802 | 1821 | 17593 | 17612 | TACTCTTGTTGAACAGCTGC | 17 | 576 |
| 1238336 | 1845 | 1864 | 17636 | 17655 | TGAATATGTCCTCTAGCCAG | 31 | 577 |
| 1238358 | 1875 | 1894 | 17666 | 17685 | CTTTCATATATGTTACAGTT | 11 | 578 |
| 1238380 | 1911 | 1930 | 17702 | 17721 | ACCATTCCCAAACATTTGAT | 83 | 579 |
| 1238402 | 1995 | 2014 | 17786 | 17805 | GCCTTAATTACCTATAGTTT | 13 | 580 |
| 1238424 | 2031 | 2050 | 17822 | 17841 | GCCTTCAGTGTCTAGAAGGC | 93 | 581 |
| 1238446 | 2081 | 2100 | 17872 | 17891 | CTGTATGTCAAAATCATTCT | 23 | 582 |
| 1238468 | 2117 | 2136 | 17908 | 17927 | CTCTATGATGATGGTGCTTT | 18 | 583 |
| 1238490 | 2147 | 2166 | 17938 | 17957 | GCACACTGACCATTTTTTAA | 9 | 584 |
| 1238512 | 2176 | 2195 | 17967 | 17986 | ATAAAGAAATGCAAGCAGTT | 42 | 585 |
| 1238534 | 2235 | 2254 | 18026 | 18045 | CCAATTACAGAAACTATGAA | 59 | 586 |
| 1238556 | 2266 | 2285 | 18057 | 18076 | TAGATTGTCTCCCTATTCTT | 59 | 587 |
| 1238578 | 2299 | 2318 | 18090 | 18109 | ATATTTCTGTCATCTCCAAC | 36 | 588 |
| 1238600 | 2326 | 2345 | 18117 | 18136 | AATTTCTTTTTCCACTTCAA | 14 | 589 |
| 1238622 | 2372 | 2391 | 18163 | 18182 | TATCAAACAATTCAGGGAAT | 34 | 590 |
| 1238644 | 2409 | 2428 | 18200 | 18219 | CATTGCAGAAAAGTAATACA | 66 | 591 |
| 1238666 | 2512 | 2531 | 18303 | 18322 | TAACTGCTCTAAACAAAACT | 85 | 592 |
| 1238688 | 2574 | 2593 | 18365 | 18384 | GTTTCCCACATATTAAGTAT | 22 | 593 |
| 1238710 | 2716 | 2735 | 18507 | 18526 | AACAAAACAAGAACATGCAA | 74 | 594 |
| 1238732 | N/A | N/A | 4715 | 4734 | CCATGAAGATCCTCATCATT | 84 | 595 |
| 1238754 | N/A | N/A | 4814 | 4833 | TCTACCAGGAGTTTTCCCTA | 86 | 596 |
| 1238776 | N/A | N/A | 4858 | 4877 | CCTATGTTTTTGATAATTAT | 65 | 597 |
| 1238798 | N/A | N/A | 4893 | 4912 | TCCAGAAGTTTAACATATTT | 58 | 598 |
| 1238820 | N/A | N/A | 4960 | 4979 | TAAAATTGCTCCTTTCCACT | 58 | 599 |
| 1238842 | N/A | N/A | 5020 | 5039 | GCTTTTCCCCTTACTGGTTA | 34 | 600 |
| 1238864 | N/A | N/A | 5077 | 5096 | GTGGAAGACTTGTGTTAGAT | 3 | 601 |

TABLE 9 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238886 | N/A | N/A | 5121 | 5140 | ATTTTGCCATTTATCTATTA | 42 | 602 |
| 1238908 | N/A | N/A | 5172 | 5191 | TGATAACCCAAACATGCTCT | 47 | 603 |
| 1238930 | N/A | N/A | 5304 | 5323 | CTGCAGAACCATCTTTGTGA | 77 | 604 |
| 1238952 | N/A | N/A | 5416 | 5435 | CCCAATAACTCATACATACA | 72 | 605 |
| 1238974 | N/A | N/A | 5520 | 5539 | TTGCAGGTAAGTTCTCAGGA | 4 | 606 |
| 1238996 | N/A | N/A | 5641 | 5660 | TGTGTCATAATTTTCTTAGC | 9 | 607 |
| 1239018 | N/A | N/A | 5693 | 5712 | CAGGCTCCAAAATCATGATT | 54 | 608 |
| 1239040 | N/A | N/A | 5738 | 5757 | GTTAATAACCCACTTTTTTA | 96 | 609 |
| 1239062 | N/A | N/A | 5857 | 5876 | GCAATATATTCACCAAAGGA | 10 | 610 |
| 1239084 | N/A | N/A | 5983 | 6002 | GGCTAAAAATCTTTTATTCT | 49 | 611 |
| 1239106 | N/A | N/A | 6292 | 6311 | CCTGACCCTCATTTTCTGTG | 69 | 612 |
| 1239128 | N/A | N/A | 6427 | 6446 | CATAATTCTAAAAATCTGTG | 76 | 613 |
| 1239150 | N/A | N/A | 6503 | 6522 | GCAGAAACTTCTGTTATGTT | 37 | 614 |
| 1239172 | N/A | N/A | 6699 | 6718 | TAGCCATCACTGGGTTAGAT | 37 | 615 |
| 1239194 | N/A | N/A | 6858 | 6877 | GAAGGATTACCTCCCTTAAA | 81 | 616 |
| 1239216 | N/A | N/A | 7203 | 7222 | GCTAAGTAAATTCCCTTGTT | 45 | 617 |
| 1239238 | N/A | N/A | 7622 | 7641 | ACATTATGAAATTATACTCA | 74 | 618 |
| 1239260 | N/A | N/A | 8161 | 8180 | GCTATCTTTCTATTTGTGTC | 22 | 619 |
| 1239282 | N/A | N/A | 8344 | 8363 | GAGAGCTTTTCCTCTTAGAT | 78 | 620 |
| 1239304 | N/A | N/A | 8643 | 8662 | CGAAGCAAATTCAACAGCTC | 63 | 621 |
| 1239326 | N/A | N/A | 8983 | 9002 | GCATCAGACTTACACTTCAC | 19 | 622 |
| 1239348 | N/A | N/A | 9368 | 9387 | ATGAGCTCAACAGGGTGGTA | 69 | 623 |
| 1239370 | N/A | N/A | 9566 | 9585 | AGGATAGTCTCTTTCCATCA | 28 | 624 |
| 1239392 | N/A | N/A | 9939 | 9958 | GTAGAGATAAACATTTGGGC | 17 | 625 |
| 1239414 | N/A | N/A | 10679 | 10698 | GACACAGTTTTGAATAAGAT | 44 | 626 |
| 1239436 | N/A | N/A | 10787 | 10806 | ACAACACATTATTGTGCCAC | 74 | 627 |
| 1239458 | N/A | N/A | 12454 | 12473 | TGCTATCGAATACTATGCAG | 93 | 628 |
| 1239480 | N/A | N/A | 13531 | 13550 | GTGTGATCATGCACATAGAA | 67 | 629 |
| 1239502 | N/A | N/A | 13738 | 13757 | CTCTGGCATATTTCAAGATA | 72 | 630 |
| 1239524 | N/A | N/A | 14158 | 14177 | CCATATTTATAAATTTACAA | 75 | 631 |
| 1239546 | N/A | N/A | 14369 | 14388 | GTGCTTATTATTCATGTTCT | 27 | 632 |
| 1239568 | N/A | N/A | 14779 | 14798 | TCTTCAACAGCCTCCCAACC | 74 | 633 |
| 1239590 | N/A | N/A | 14921 | 14940 | TGAATTTTCTCTCCCAGCAT | 75 | 634 |
| 1239612 | N/A | N/A | 15218 | 15237 | ATATATTTGAAAGTTACAAG | 77 | 635 |
| 1239634 | N/A | N/A | 15345 | 15364 | GCTAATGATTAAACTGGATA | 45 | 636 |
| 1239656 | N/A | N/A | 15414 | 15433 | TTACCTTTATCACCCAATTA | 97 | 637 |
| 1239678 | N/A | N/A | 15491 | 15510 | GTTTTTAGTACATTTAATGA | 72 | 638 |

TABLE 9-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239700 | N/A | N/A | 15673 | 15692 | CTATAATGGCATATACTGGA | 31 | 639 |
| 1239722 | N/A | N/A | 15739 | 15758 | TAAACAGTACCTGCTGTACC | 89 | 640 |
| 1239744 | N/A | N/A | 15825 | 15844 | AAAATCTCTTTTCAAATTAA | 74 | 641 |
| 1239766 | N/A | N/A | 15863 | 15882 | ATTTATGACCCTTTGGAGAA | 85 | 642 |
| 1239788 | N/A | N/A | 15914 | 15933 | CTTCTAATTTTTGTACCAAA | 27 | 643 |

TABLE 10

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 11 | 66 |
| 1238117 | 42 | 61 | 3135 | 3154 | TAATTGGAAATTCGGCCCAA | 92 | 644 |
| 1238139 | 103 | 122 | 3196 | 3215 | TGATACCGCCTGCGGGTGCC | 99 | 645 |
| 1238161 | 151 | 170 | 3244 | 3263 | AGTCACCGGAAAAAACGAGT | 105 | 646 |
| 1238183 | 609 633 | 628 652 | 16400 16424 | 16419 16443 | GCCCCCAGCCACCACCATGA | 55 | 647 |
| 1238205 | 786 | 805 | 16577 | 16596 | CAAGGCCCCCCACCACTGCC | 95 | 648 |
| 1238227 | 1185 | 1204 | 16976 | 16995 | AGGAAGACCTTCCTCATCCC | 82 | 649 |
| 1238249 | 1383 | 1402 | 17174 | 17193 | CATGATGAACTCAATCAAAG | 45 | 650 |
| 1238271 | 1521 | 1540 | 17312 | 17331 | GTATCCAGGCAAAGGTATTT | 19 | 651 |
| 1238293 | 1661 | 1680 | 17452 | 17471 | AGTATCATGTGGCCTCCTAA | 12 | 652 |
| 1238315 | 1804 | 1823 | 17595 | 17614 | TTTACTCTTGTTGAACAGCT | 15 | 653 |
| 1238337 | 1847 | 1866 | 17638 | 17657 | TGTGAATATGTCCTCTAGCC | 21 | 654 |
| 1238359 | 1876 | 1895 | 17667 | 17686 | CCTTTCATATATGTTACAGT | 7 | 655 |
| 1238381 | 1912 | 1931 | 17703 | 17722 | CACCATTCCCAAACATTTGA | 87 | 656 |
| 1238403 | 1996 | 2015 | 17787 | 17806 | TGCCTTAATTACCTATAGTT | 45 | 657 |
| 1238425 | 2037 | 2056 | 17828 | 17847 | AGATTTGCCTTCAGTGTCTA | 110 | 658 |
| 1238447 | 2082 | 2101 | 17873 | 17892 | CCTGTATGTCAAAATCATTC | 37 | 659 |
| 1238469 | 2118 | 2137 | 17909 | 17928 | CCTCTATGATGATGGTGCTT | 22 | 660 |
| 1238491 | 2148 | 2167 | 17939 | 17958 | TGCACACTGACCATTTTTTA | 18 | 661 |
| 1238513 | 2188 | 2207 | 17979 | 17998 | TATGAGACAGAAATAAAGAA | 71 | 662 |
| 1238535 | 2240 | 2259 | 18031 | 18050 | AAAAGCCAATTACAGAAACT | 81 | 663 |
| 1238557 | 2267 | 2286 | 18058 | 18077 | TTAGATTGTCTCCCTATTCT | 54 | 664 |
| 1238579 | 2300 | 2319 | 18091 | 18110 | CATATTTCTGTCATCTCCAA | 37 | 665 |
| 1238601 | 2327 | 2346 | 18118 | 18137 | GAATTTCTTTTTCCACTTCA | 25 | 666 |
| 1238623 | 2373 | 2392 | 18164 | 18183 | ATATCAAACAATTCAGGGAA | 58 | 667 |

TABLE 10 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238645 | 2420 | 2439 | 18211 | 18230 | GCCAATAATAACATTGCAGA | 21 | 668 |
| 1238667 | 2513 | 2532 | 18304 | 18323 | TTAACTGCTCTAAACAAAAC | 105 | 669 |
| 1238689 | 2575 | 2594 | 18366 | 18385 | GGTTTCCCACATATTAAGTA | 25 | 670 |
| 1238711 | 2720 | 2739 | 18511 | 18530 | ATATAACAAAACAAGAACAT | 74 | 671 |
| 1238733 | N/A | N/A | 4716 | 4735 | GCCATGAAGATCCTCATCAT | 63 | 672 |
| 1238755 | N/A | N/A | 4820 | 4839 | TCCTATTCTACCAGGAGTTT | 88 | 673 |
| 1238777 | N/A | N/A | 4859 | 4878 | TCCTATGTTTTTGATAATTA | 81 | 674 |
| 1238799 | N/A | N/A | 4895 | 4914 | TTTCCAGAAGTTTAACATAT | 62 | 675 |
| 1238821 | N/A | N/A | 4961 | 4980 | GTAAAATTGCTCCTTTCCAC | 53 | 676 |
| 1238843 | N/A | N/A | 5021 | 5040 | TGCTTTTCCCCTTACTGGTT | 53 | 677 |
| 1238865 | N/A | N/A | 5094 | 5113 | AATATTTTCCTTTCGGTGTG | 46 | 678 |
| 1238887 | N/A | N/A | 5122 | 5141 | CATTTTGCCATTTATCTATT | 54 | 679 |
| 1238909 | N/A | N/A | 5173 | 5192 | ATGATAACCCAAACATGCTC | 65 | 680 |
| 1238931 | N/A | N/A | 5306 | 5325 | GACTGCAGAACCATCTTTGT | 64 | 681 |
| 1238953 | N/A | N/A | 5417 | 5436 | CCCCAATAACTCATACATAC | 66 | 682 |
| 1238975 | N/A | N/A | 5535 | 5554 | TGTTTGTTTCTTCCATTGCA | 12 | 683 |
| 1238997 | N/A | N/A | 5642 | 5661 | ATGTGTCATAATTTTCTTAG | 18 | 684 |
| 1239019 | N/A | N/A | 5694 | 5713 | ACAGGCTCCAAAATCATGAT | 41 | 685 |
| 1239041 | N/A | N/A | 5739 | 5758 | AGTTAATAACCCACTTTTTT | 78 | 686 |
| 1239063 | N/A | N/A | 5859 | 5878 | GAGCAATATATTCACCAAAG | 7 | 687 |
| 1239085 | N/A | N/A | 5986 | 6005 | GTTGGCTAAAAATCTTTTAT | 33 | 688 |
| 1239107 | N/A | N/A | 6301 | 6320 | ACAGCCTTTCCTGACCCTCA | 50 | 689 |
| 1239129 | N/A | N/A | 6428 | 6447 | GCATAATTCTAAAAATCTGT | 70 | 690 |
| 1239151 | N/A | N/A | 6504 | 6523 | TGCAGAAACTTCTGTTATGT | 62 | 691 |
| 1239173 | N/A | N/A | 6703 | 6722 | GCTGTAGCCATCACTGGGTT | 46 | 692 |
| 1239195 | N/A | N/A | 6859 | 6878 | TGAAGGATTACCTCCCTTAA | 82 | 693 |
| 1239217 | N/A | N/A | 7219 | 7238 | CCCTTGTCTCTTCTGAGCTA | 73 | 694 |
| 1239239 | N/A | N/A | 7623 | 7642 | GACATTATGAAATTATACTC | 43 | 695 |
| 1239261 | N/A | N/A | 8162 | 8181 | GGCTATCTTTCTATTTGTGT | 47 | 696 |
| 1239283 | N/A | N/A | 8345 | 8364 | TGAGAGCTTTTCCTCTTAGA | 106 | 697 |
| 1239305 | N/A | N/A | 8644 | 8663 | GCGAAGCAAATTCAACAGCT | 62 | 698 |
| 1239327 | N/A | N/A | 8987 | 9006 | GGAGGCATCAGACTTACACT | 63 | 699 |
| 1239349 | N/A | N/A | 9371 | 9390 | TACATGAGCTCAACAGGGTG | 52 | 700 |
| 1239371 | N/A | N/A | 9567 | 9586 | AAGGATAGTCTCTTTCCATC | 44 | 701 |
| 1239393 | N/A | N/A | 9982 | 10001 | GGGAGTATCAATTTAAGCAA | 26 | 702 |
| 1239415 | N/A | N/A | 10719 | 10738 | GTCAGAATTCTAAGGGTCAA | 27 | 703 |

TABLE 10 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239437 | N/A | N/A | 10790 | 10809 | CCCACAACACATTATTGTGC | 118 | 704 |
| 1239459 | N/A | N/A | 12463 | 12482 | GTACATATATGCTATCGAAT | 26 | 705 |
| 1239481 | N/A | N/A | 13536 | 13555 | AATTAGTGTGATCATGCACA | 61 | 706 |
| 1239503 | N/A | N/A | 13775 | 13794 | AGATACTCTCTGTCACCAGT | 71 | 707 |
| 1239525 | N/A | N/A | 14159 | 14178 | ACCATATTTATAAATTTACA | 92 | 708 |
| 1239547 | N/A | N/A | 14370 | 14389 | TGTGCTTATTATTCATGTTC | 39 | 709 |
| 1239569 | N/A | N/A | 14785 | 14804 | CTGATTTCTTCAACAGCCTC | 83 | 710 |
| 1239591 | N/A | N/A | 14922 | 14941 | CTGAATTTTCTCTCCCAGCA | 60 | 711 |
| 1239613 | N/A | N/A | 15236 | 15255 | GGTCATAAGCAAATCAAAAT | 26 | 712 |
| 1239635 | N/A | N/A | 15350 | 15369 | TCAGAGCTAATGATTAAACT | 54 | 713 |
| 1239657 | N/A | N/A | 15415 | 15434 | CTTACCTTTATCACCCAATT | 65 | 714 |
| 1239679 | N/A | N/A | 15493 | 15512 | TGGTTTTTAGTACATTTAAT | 39 | 715 |
| 1239701 | N/A | N/A | 15681 | 15700 | CGTAAAACCTATAATGGCAT | 53 | 716 |
| 1239723 | N/A | N/A | 15742 | 15761 | TGCTAAACAGTACCTGCTGT | 91 | 717 |
| 1239745 | N/A | N/A | 15828 | 15847 | TCAAAATCTCTTTTCAAAT | 114 | 718 |
| 1239767 | N/A | N/A | 15872 | 15891 | AGAATGACAATTTATGACCC | 45 | 719 |
| 1239789 | N/A | N/A | 15916 | 15935 | TTCTTCTAATTTTGTACCA | 47 | 720 |

TABLE 11

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 9 | 66 |
| 1238118 | 45 | 64 | 3138 | 3157 | CTTTAATTGGAAATTCGGCC | 96 | 721 |
| 1238140 | 104 | 123 | 3197 | 3216 | TTGATACCGCCTGCGGGTGC | 78 | 722 |
| 1238162 | 451 | 470 | 16242 | 16261 | GCCACAAAGAGAACCAGCAT | 71 | 723 |
| 1238184 | 610 634 | 629 653 | 16401 16425 | 16420 16444 | TGCCCCCAGCCACCACCATG | 56 | 724 |
| 1238206 | 787 | 806 | 16578 | 16597 | CCAAGGCCCCCCACCACTGC | 102 | 725 |
| 1238228 | 1186 | 1205 | 16977 | 16996 | CAGGAAGACCTTCCTCATCC | 99 | 726 |
| 1238250 | 1384 | 1403 | 17175 | 17194 | TCATGATGAACTCAATCAAA | 40 | 727 |
| 1238272 | 1583 | 1602 | 17374 | 17393 | ATGAAATCTCTACTAAGATA | 57 | 728 |
| 1238294 | 1662 | 1681 | 17453 | 17472 | AAGTATCATGTGGCCTCCTA | 22 | 729 |
| 1238316 | 1805 | 1824 | 17596 | 17615 | ATTTACTCTTGTTGAACAGC | 10 | 730 |
| 1238338 | 1848 | 1867 | 17639 | 17658 | CTGTGAATATGTCCTCTAGC | 13 | 731 |
| 1238360 | 1877 | 1896 | 17668 | 17687 | GCCTTTCATATATGTTACAG | 12 | 732 |

TABLE 11 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238382 | 1914 | 1933 | 17705 | 17724 | GGCACCATTCCCAAACATTT | 92 | 733 |
| 1238404 | 1997 | 2016 | 17788 | 17807 | CTGCCTTAATTACCTATAGT | 23 | 734 |
| 1238426 | 2038 | 2057 | 17829 | 17848 | GAGATTTGCCTTCAGTGTCT | 53 | 735 |
| 1238448 | 2087 | 2106 | 17878 | 17897 | GCTCTCCTGTATGTCAAAAT | 48 | 736 |
| 1238470 | 2122 | 2141 | 17913 | 17932 | TCATCCTCTATGATGATGGT | 67 | 737 |
| 1238492 | 2149 | 2168 | 17940 | 17959 | TTGCACACTGACCATTTTTT | 19 | 738 |
| 1238514 | 2189 | 2208 | 17980 | 17999 | TTATGAGACAGAAATAAAGA | 99 | 739 |
| 1238536 | 2241 | 2260 | 18032 | 18051 | CAAAAGCCAATTACAGAAAC | 80 | 740 |
| 1238558 | 2268 | 2287 | 18059 | 18078 | TTTAGATTGTCTCCCTATTC | 55 | 741 |
| 1238580 | 2301 | 2320 | 18092 | 18111 | TCATATTTCTGTCATCTCCA | 19 | 742 |
| 1238602 | 2328 | 2347 | 18119 | 18138 | AGAATTTCTTTTTCCACTTC | 25 | 743 |
| 1238624 | 2374 | 2393 | 18165 | 18184 | AATATCAAACAATTCAGGGA | 62 | 744 |
| 1238646 | 2422 | 2441 | 18213 | 18232 | AAGCCAATAATAACATTGCA | 47 | 745 |
| 1238668 | 2520 | 2539 | 18311 | 18330 | TCAGATGTTAACTGCTCTAA | 27 | 746 |
| 1238690 | 2576 | 2595 | 18367 | 18386 | GGGTTTCCCACATATTAAGT | 56 | 747 |
| 1238712 | 2721 | 2740 | 18512 | 18531 | TATATAACAAAACAAGAACA | 105 | 748 |
| 1238734 | N/A | N/A | 4741 | 4760 | GCTCTCAGAACAAGAAAATA | 73 | 749 |
| 1238756 | N/A | N/A | 4822 | 4841 | AATCCTATTCTACCAGGAGT | 79 | 750 |
| 1238778 | N/A | N/A | 4863 | 4882 | CTGTTCCTATGTTTTTGATA | 65 | 751 |
| 1238800 | N/A | N/A | 4899 | 4918 | GATTTTTCCAGAAGTTTAAC | 47 | 752 |
| 1238822 | N/A | N/A | 4962 | 4981 | AGTAAAATTGCTCCTTTCCA | 47 | 753 |
| 1238844 | N/A | N/A | 5038 | 5057 | CATCCTACCCCTCTGCCTGC | 82 | 754 |
| 1238866 | N/A | N/A | 5095 | 5114 | TAATATTTTCCTTTCGGTGT | 37 | 755 |
| 1238888 | N/A | N/A | 5123 | 5142 | TCATTTTGCCATTTATCTAT | 41 | 756 |
| 1238910 | N/A | N/A | 5175 | 5194 | AAATGATAACCCAAACATGC | 45 | 757 |
| 1238932 | N/A | N/A | 5322 | 5341 | CCAAGGTCACAAAATTGACT | 102 | 758 |
| 1238954 | N/A | N/A | 5423 | 5442 | AAATGCCCCCAATAACTCAT | 54 | 759 |
| 1238976 | N/A | N/A | 5554 | 5573 | ATACATGCCTGTTTTTGTTT | 60 | 760 |
| 1238998 | N/A | N/A | 5643 | 5662 | AATGTGTCATAATTTTCTTA | 24 | 761 |
| 1239020 | N/A | N/A | 5697 | 5716 | ATCACAGGCTCCAAAATCAT | 78 | 762 |
| 1239042 | N/A | N/A | 5741 | 5760 | GCAGTTAATAACCCACTTTT | 22 | 763 |
| 1239064 | N/A | N/A | 5860 | 5879 | AGAGCAATATATTCACCAAA | 10 | 764 |
| 1239086 | N/A | N/A | 5987 | 6006 | CGTTGGCTAAAAATCTTTTA | 29 | 765 |
| 1239108 | N/A | N/A | 6305 | 6324 | GATCACAGCCTTTCCTGACC | 50 | 766 |
| 1239130 | N/A | N/A | 6430 | 6449 | CAGCATAATTCTAAAAATCT | 99 | 767 |
| 1239152 | N/A | N/A | 6506 | 6525 | GGTGCAGAAACTTCTGTTAT | 58 | 768 |
| 1239174 | N/A | N/A | 6704 | 6723 | TGCTGTAGCCATCACTGGGT | 49 | 769 |

TABLE 11-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239196 | N/A | N/A | 6860 | 6879 | CTGAAGGATTACCTCCCTTA | 78 | 770 |
| 1239218 | N/A | N/A | 7226 | 7245 | ATAATGTCCCTTGTCTCTTC | 44 | 771 |
| 1239240 | N/A | N/A | 7698 | 7717 | ACACAATACATATAATCTTA | 50 | 772 |
| 1239262 | N/A | N/A | 8163 | 8182 | AGGCTATCTTTCTATTTGTG | 38 | 773 |
| 1239284 | N/A | N/A | 8346 | 8365 | TTGAGAGCTTTTCCTCTTAG | 92 | 774 |
| 1239306 | N/A | N/A | 8646 | 8665 | TAGCGAAGCAAATTCAACAG | 78 | 775 |
| 1239328 | N/A | N/A | 9033 | 9052 | GATCTCTTAGATTTTTGGAC | 25 | 776 |
| 1239350 | N/A | N/A | 9380 | 9399 | TAGAATAAATACATGAGCTC | 92 | 777 |
| 1239372 | N/A | N/A | 9635 | 9654 | TGAAAATCAATATCATTCCT | 58 | 778 |
| 1239394 | N/A | N/A | 9983 | 10002 | TGGGAGTATCAATTTAAGCA | 15 | 779 |
| 1239416 | N/A | N/A | 10721 | 10740 | GTGTCAGAATTCTAAGGGTC | 29 | 780 |
| 1239438 | N/A | N/A | 10791 | 10810 | ACCCACAACACATTATTGTG | 83 | 781 |
| 1239460 | N/A | N/A | 12468 | 12487 | GTGTGGTACATATATGCTAT | 29 | 782 |
| 1239482 | N/A | N/A | 13542 | 13561 | ATTTGCAATTAGTGTGATCA | 83 | 783 |
| 1239504 | N/A | N/A | 13777 | 13796 | TAAGATACTCTCTGTCACCA | 57 | 784 |
| 1239526 | N/A | N/A | 14190 | 14209 | ACTAAATATTTATAATGGAT | 85 | 785 |
| 1239548 | N/A | N/A | 14371 | 14390 | CTGTGCTTATTATTCATGTT | 34 | 786 |
| 1239570 | N/A | N/A | 14792 | 14811 | TTCTCACCTGATTTCTTCAA | 88 | 787 |
| 1239592 | N/A | N/A | 14925 | 14944 | TGACTGAATTTTCTCTCCCA | 74 | 788 |
| 1239614 | N/A | N/A | 15237 | 15256 | TGGTCATAAGCAAATCAAAA | 30 | 789 |
| 1239636 | N/A | N/A | 15351 | 15370 | TTCAGAGCTAATGATTAAAC | 70 | 790 |
| 1239658 | N/A | N/A | 15416 | 15435 | CCTTACCTTTATCACCCAAT | 53 | 791 |
| 1239680 | N/A | N/A | 15507 | 15526 | CATGTACAGTTCAATGGTTT | 49 | 792 |
| 1239702 | N/A | N/A | 15682 | 15701 | CCGTAAAACCTATAATGGCA | 28 | 793 |
| 1239724 | N/A | N/A | 15745 | 15764 | GATTGCTAAACAGTACCTGC | 22 | 794 |
| 1239746 | N/A | N/A | 15829 | 15848 | ATCAAAAATCTCTTTTCAAA | 93 | 795 |
| 1239768 | N/A | N/A | 15873 | 15892 | CAGAATGACAATTTATGACC | 39 | 796 |
| 1239790 | N/A | N/A | 15917 | 15936 | TTTCTTCTAATTTTTGTACC | 74 | 797 |

TABLE 12

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 7 | 66 |
| 1238122 | 51 | 70 | 3144 | 3163 | AATCATCTTTAATTGGAAAT | 108 | 798 |

TABLE 12 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238144 | 120 | 139 | 3213 | 3232 | TGAACACTTGCATCAGTTGA | 87 | 799 |
| 1238166 | 468 | 487 | 16259 | 16278 | CCAGGTCACTCCATGTGGCC | 59* | 800 |
| 1238188 | 593 617 | 612 636 | 16384 16408 | 16403 16427 | ATGAGGCTGCCCCCAGCCAC | 75 | 801 |
| 1238210 | 858 | 877 | 16649 | 16668 | AGTAACGGTCCTCATAGTCA | 56 | 802 |
| 1238232 | 1199 | 1218 | 16990 | 17009 | AAGATGGTGAAAACAGGAAG | 67 | 803 |
| 1238254 | 1420 | 1439 | 17211 | 17230 | CTGTTATACTTTTACTGGCC | 21 | 804 |
| 1238276 | 1589 | 1608 | 17380 | 17399 | ATAGCTATGAAATCTCTACT | 32 | 805 |
| 1238298 | 1678 | 1697 | 17469 | 17488 | TAGGATTTTTTGAATAAGT | 33 | 806 |
| 1238320 | 1811 | 1830 | 17602 | 17621 | GACAATATTTACTCTTGTTG | 14 | 807 |
| 1238342 | 1854 | 1873 | 17645 | 17664 | TGTTCACTGTGAATATGTCC | 12 | 808 |
| 1238364 | 1884 | 1903 | 17675 | 17694 | CCCAGAAGCCTTTCATATAT | 31 | 809 |
| 1238386 | 1920 | 1939 | 17711 | 17730 | TCCAAGGGCACCATTCCCAA | 97 | 810 |
| 1238408 | 2003 | 2022 | 17794 | 17813 | TTTCAGCTGCCTTAATTACC | 37 | 811 |
| 1238430 | 2042 | 2061 | 17833 | 17852 | AAAGGAGATTTGCCTTCAGT | 82 | 812 |
| 1238452 | 2092 | 2111 | 17883 | 17902 | CTGCAGCTCTCCTGTATGTC | 71 | 813 |
| 1238474 | 2126 | 2145 | 17917 | 17936 | TACATCATCCTCTATGATGA | 96 | 814 |
| 1238496 | 2155 | 2174 | 17946 | 17965 | TTTTCTTTGCACACTGACCA | 15 | 815 |
| 1238518 | 2209 | 2228 | 18000 | 18019 | CTAATTCTGGTTTTGACAA | 61 | 816 |
| 1238540 | 2250 | 2269 | 18041 | 18060 | TCTTTGATTCAAAAGCCAAT | 51 | 817 |
| 1238562 | 2275 | 2294 | 18066 | 18085 | GATATTTTTTAGATTGTCTC | 42 | 818 |
| 1238584 | 2305 | 2324 | 18096 | 18115 | TCAATCATATTTCTGTCATC | 31 | 819 |
| 1238606 | 2334 | 2353 | 18125 | 18144 | ATTAACAGAATTTCTTTTTC | 86 | 820 |
| 1238628 | 2380 | 2399 | 18171 | 18190 | GGTGACAATATCAAACAATT | 18 | 821 |
| 1238650 | 2439 | 2458 | 18230 | 18249 | GAATACTCACAAAGTGCAAG | 37 | 822 |
| 1238672 | 2531 | 2550 | 18322 | 18341 | CATTAGACACTTCAGATGTT | 59 | 823 |
| 1238694 | 2621 | 2640 | 18412 | 18431 | ATGAAACGATTCAGTGCACA | 52 | 824 |
| 1238716 | 2730 | 2749 | 18521 | 18540 | CAATTTTTTATATAACAAA | 85 | 825 |
| 1238738 | N/A | N/A | 4747 | 4766 | CGTGATGCTCTCAGAACAAG | 27 | 826 |
| 1238760 | N/A | N/A | 4828 | 4847 | ATCCTTAATCCTATTCTACC | 86 | 827 |
| 1238782 | N/A | N/A | 4876 | 4895 | TTTATCCAATTCCCTGTTCC | 67 | 828 |
| 1238804 | N/A | N/A | 4904 | 4923 | TTGTTGATTTTCCAGAAGT | 28 | 829 |
| 1238826 | N/A | N/A | 4968 | 4987 | TGTGTAAGTAAAATTGCTCC | 41 | 830 |
| 1238848 | N/A | N/A | 5045 | 5064 | CAAATCACATCCTACCCCTC | 80 | 831 |
| 1238870 | N/A | N/A | 5100 | 5119 | AATCTTAATATTTTCCTTTC | 82 | 832 |
| 1238892 | N/A | N/A | 5132 | 5151 | AATGACTCATCATTTTGCCA | 28 | 833 |
| 1238914 | N/A | N/A | 5195 | 5214 | TGGTTATTTTAATAGATGTA | 18 | 834 |

TABLE 12 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238936 | N/A | N/A | 5380 | 5399 | ATCATTTCCTCCATTCTATG | 69 | 835 |
| 1238958 | N/A | N/A | 5451 | 5470 | GCTTAACAAAATGTTTGTCA | 13 | 836 |
| 1238980 | N/A | N/A | 5581 | 5600 | TTCTAATTTTAGATCATTCT | 66 | 837 |
| 1239002 | N/A | N/A | 5655 | 5674 | TTCATTTCAGTTAATGTGTC | 23 | 838 |
| 1239024 | N/A | N/A | 5712 | 5731 | AGTTTTTCCCCACATATCAC | 50 | 839 |
| 1239046 | N/A | N/A | 5783 | 5802 | TTCAGATTTTTCACATATGC | 19 | 840 |
| 1239068 | N/A | N/A | 5865 | 5884 | TAGTGAGAGCAATATATTCA | 47 | 841 |
| 1239090 | N/A | N/A | 6141 | 6160 | GTTTTGAAAAATATTCAGGA | 53 | 842 |
| 1239112 | N/A | N/A | 6319 | 6338 | GATCAAGAGCTTGTGATCAC | 95 | 843 |
| 1239134 | N/A | N/A | 6443 | 6462 | CCCTTACATAATTCAGCATA | 68 | 844 |
| 1239156 | N/A | N/A | 6531 | 6550 | TGACAGCCATGTTCAGTGTC | 100 | 845 |
| 1239178 | N/A | N/A | 6725 | 6744 | CACTTAGGAGTTATTTTATA | 61 | 846 |
| 1239200 | N/A | N/A | 6878 | 6897 | CATTTATAATGCTTTTCACT | 70 | 847 |
| 1239222 | N/A | N/A | 7282 | 7301 | CTTAATTAGTTACATCGGGA | 9 | 848 |
| 1239244 | N/A | N/A | 7758 | 7777 | CGTGTGAGCATTCTTGTCTT | 81 | 849 |
| 1239266 | N/A | N/A | 8189 | 8208 | AACATTAATTATCCCCCCAT | 82 | 850 |
| 1239288 | N/A | N/A | 8417 | 8436 | CATTGTACCTCAACACAATA | 94 | 851 |
| 1239310 | N/A | N/A | 8751 | 8770 | ACCAGCATTATCCTGATGTC | 55 | 852 |
| 1239332 | N/A | N/A | 9067 | 9086 | TCAAAGGTAATTTTATAACC | 93 | 853 |
| 1239354 | N/A | N/A | 9422 | 9441 | CTAGGTATAATTTTTTTACC | 97 | 854 |
| 1239376 | N/A | N/A | 9652 | 9671 | TGTTGAAAAGTTTTCAATGA | 79 | 855 |
| 1239398 | N/A | N/A | 10096 | 10115 | GGTGATGCCATCTACTGAAA | 89 | 856 |
| 1239420 | N/A | N/A | 10736 | 10755 | TAACACACATTTCAAGTGTC | 92 | 857 |
| 1239442 | N/A | N/A | 11089 | 11108 | AGTACCATAACCTTTTTTTT | 53 | 858 |
| 1239464 | N/A | N/A | 12639 | 12658 | ACGGAAATATCATTCGACTC | 47 | 859 |
| 1239486 | N/A | N/A | 13554 | 13573 | CTAGCTGACACTATTTGCAA | 89 | 860 |
| 1239508 | N/A | N/A | 13879 | 13898 | AGAGGAGAAGAACCAGGCAC | 88 | 861 |
| 1239530 | N/A | N/A | 14214 | 14233 | GCATAAGGAATAATCAAACT | 57 | 862 |
| 1239552 | N/A | N/A | 14385 | 14404 | TTATGTTATTTCCTCTGTGC | 35 | 863 |
| 1239574 | N/A | N/A | 14812 | 14831 | TTATTCGGTGCTTCCATCAC | 68 | 864 |
| 1239596 | N/A | N/A | 14983 | 15002 | ATGTCAGCACCTTCTCCATT | 57 | 865 |
| 1239618 | N/A | N/A | 15270 | 15289 | CTAACATTATTGAAATGGGA | 42 | 866 |
| 1239640 | N/A | N/A | 15367 | 15386 | ATTATTTTTCATCTCCTTCA | 64 | 867 |
| 1239662 | N/A | N/A | 15420 | 15439 | AACCCCTTACCTTTATCACC | 52 | 868 |
| 1239684 | N/A | N/A | 15520 | 15539 | ATTCACCATATACCATGTAC | 51 | 869 |
| 1239706 | N/A | N/A | 15698 | 15717 | AAATCATCACTGTGTGCCGT | 42 | 870 |
| 1239728 | N/A | N/A | 15769 | 15788 | AGAGACCTATGACAATAGTA | 64 | 871 |

TABLE 12 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239750 | N/A | N/A | 15834 | 15853 | ATCAAATCAAAAATCTCTTT | 91 | 872 |
| 1239772 | N/A | N/A | 15883 | 15902 | ATCAAACATCCAGAATGACA | 70 | 873 |
| 1239794 | N/A | N/A | 15949 | 15968 | GTTCATTATTTAACATTTTA | 74 | 874 |

TABLE 13

Reduction of PRNP RNA

| Compound ID | SEQ ID NO: 1 Site | SEQ ID NO: 1 Site | SEQ ID NO: 2 Site | SEQ ID NO: 2 Site | Sequence (5' to 3') | PRNP (% UTC) RTS 42354 | PRNP (% UTC) RTS 42359 | SEQ ID NO |
|---|---|---|---|---|---|---|---|---|
| 1201142 | 1963 | 1982 | 17754 | 17773 | GCCACATATAGGGTCCTTTA | 8 | 12 | 66 |
| 1238123 | 54 | 73 | 3147 | 3166 | AAAAATCATCTTTAATTGGA | 92 | 88 | 875 |
| 1238145 | 121 | 140 | 3214 | 3233 | TTGAACACTTGCATCAGTTG | 81 | 86 | 876 |
| 1238167 | 508 | 527 | 16299 | 16318 | GTGTTCCATCCTCCAGGCTT | 5* | 71 | 877 |
| 1238189 | 594 618 | 613 637 | 16385 16409 | 16404 16428 | CATGAGGCTGCCCCCAGCCA | 84 | 233 | 878 |
| 1238211 | 874 | 893 | 16665 | 16684 | TGCATGTTTTCACGATAGTA | 55 | 50 | 879 |
| 1238233 | 1264 | 1283 | 17055 | 17074 | TGAGACACCACCACTAAAAG | 68 | 72 | 880 |
| 1238255 | 1424 | 1443 | 17215 | 17234 | TTTGCTGTTATACTTTTACT | 13 | 14 | 881 |
| 1238277 | 1591 | 1610 | 17382 | 17401 | AAATAGCTATGAAATCTCTA | 31 | 40 | 882 |
| 1238299 | 1680 | 1699 | 17471 | 17490 | TCTAGGATTTTTTGAATAA | 60 | 70 | 883 |
| 1238321 | 1812 | 1831 | 17603 | 17622 | TGACAATATTTACTCTTGTT | 13 | 13 | 884 |
| 1238343 | 1855 | 1874 | 17646 | 17665 | ATGTTCACTGTGAATATGTC | 27 | 26 | 885 |
| 1238365 | 1885 | 1904 | 17676 | 17695 | TCCCAGAAGCCTTTCATATA | 32 | 25 | 886 |
| 1238387 | 1921 | 1940 | 17712 | 17731 | CTCCAAGGGCACCATTCCCA | 85 | 79 | 887 |
| 1238409 | 2009 | 2028 | 17800 | 17819 | TTTACTTTTCAGCTGCCTTA | 9 | 10 | 888 |
| 1238431 | 2043 | 2062 | 17834 | 17853 | CAAAGGAGATTTGCCTTCAG | 71 | 68 | 889 |
| 1238453 | 2093 | 2112 | 17884 | 17903 | ACTGCAGCTCTCCTGTATGT | 84 | 94 | 890 |
| 1238475 | 2127 | 2146 | 17918 | 17937 | TTACATCATCCTCTATGATG | 89 | 94 | 891 |
| 1238497 | 2156 | 2175 | 17947 | 17966 | CTTTTCTTTGCACACTGACC | 8 | 10 | 892 |
| 1238519 | 2210 | 2229 | 18001 | 18020 | CCTAATTCTGGTTTTTGACA | 27 | 36 | 893 |
| 1238541 | 2251 | 2270 | 18042 | 18061 | TTCTTTGATTCAAAAGCCAA | 72 | 78 | 894 |
| 1238563 | 2276 | 2295 | 18067 | 18086 | AGATATTTTTAGATTGTCT | 53 | 57 | 895 |
| 1238585 | 2306 | 2325 | 18097 | 18116 | ATCAATCATATTTCTGTCAT | 37 | 40 | 896 |
| 1238607 | 2339 | 2358 | 18130 | 18149 | TTAACATTAACAGAATTTCT | 66 | 56 | 897 |
| 1238629 | 2381 | 2400 | 18172 | 18191 | AGGTGACAATATCAAACAAT | 26 | 25 | 898 |
| 1238651 | 2440 | 2459 | 18231 | 18250 | AGAATACTCACAAAGTGCAA | 41 | 37 | 899 |
| 1238673 | 2532 | 2551 | 18323 | 18342 | GCATTAGACACTTCAGATGT | 35 | 43 | 900 |

TABLE 13 -continued

Reduction of PRNP RNA

| Compound ID | SEQ ID NO: 1 Site | SEQ ID NO: 1 Site | SEQ ID NO: 2 Site | SEQ ID NO: 2 Site | Sequence (5' to 3') | PRNP (% UTC) RTS 42354 | PRNP (% UTC) RTS 42359 | SEQ ID NO |
|---|---|---|---|---|---|---|---|---|
| 1238695 | 2629 | 2648 | 18420 | 18439 | ATTCTTACATGAAACGATTC | 69 | 54 | 901 |
| 1238717 | 2732 | 2751 | 18523 | 18542 | TACAATTTTTTTATATAACA | 117 | 118 | 902 |
| 1238739 | N/A | N/A | 4748 | 4767 | CCGTGATGCTCTCAGAACAA | 31 | 31 | 903 |
| 1238761 | N/A | N/A | 4829 | 4848 | AATCCTTAATCCTATTCTAC | 91 | 74 | 904 |
| 1238783 | N/A | N/A | 4877 | 4896 | ATTTATCCAATTCCCTGTTC | 89 | 80 | 905 |
| 1238805 | N/A | N/A | 4905 | 4924 | GTTGTTGATTTTTCCAGAAG | 7 | 8 | 906 |
| 1238827 | N/A | N/A | 4969 | 4988 | TTGTGTAAGTAAAATTGCTC | 47 | 49 | 907 |
| 1238849 | N/A | N/A | 5046 | 5065 | ACAAATCACATCCTACCCCT | 96 | 89 | 908 |
| 1238871 | N/A | N/A | 5101 | 5120 | TAATCTTAATATTTTCCTTT | 113 | 115 | 909 |
| 1238893 | N/A | N/A | 5133 | 5152 | AAATGACTCATCATTTTGCC | 26 | 24 | 910 |
| 1238915 | N/A | N/A | 5196 | 5215 | TTGGTTATTTTAATAGATGT | 33 | 28 | 911 |
| 1238937 | N/A | N/A | 5382 | 5401 | CTATCATTTCCTCCATTCTA | 68 | 91 | 912 |
| 1238959 | N/A | N/A | 5452 | 5471 | TGCTTAACAAAATGTTTGTC | 67 | 58 | 913 |
| 1238981 | N/A | N/A | 5582 | 5601 | GTTCTAATTTTAGATCATTC | 19 | 22 | 914 |
| 1239003 | N/A | N/A | 5658 | 5677 | ATGTTCATTTCAGTTAATGT | 20 | 19 | 915 |
| 1239025 | N/A | N/A | 5713 | 5732 | CAGTTTTTCCCCACATATCA | 38 | 37 | 916 |
| 1239047 | N/A | N/A | 5784 | 5803 | TTTCAGATTTTTCACATATG | 34 | 40 | 917 |
| 1239069 | N/A | N/A | 5888 | 5907 | GTGAACTATTTTTAAACGC | 35 | 31 | 918 |
| 1239091 | N/A | N/A | 6158 | 6177 | ATGGCTGAAATTGTTCAGTT | 75 | 53 | 919 |
| 1239113 | N/A | N/A | 6333 | 6352 | CCGAGTGGCCTCTGGATCAA | 58 | 69 | 920 |
| 1239135 | N/A | N/A | 6444 | 6463 | TCCCTTACATAATTCAGCAT | 59 | 63 | 921 |
| 1239157 | N/A | N/A | 6533 | 6552 | GTTGACAGCCATGTTCAGTG | 23 | 24 | 922 |
| 1239179 | N/A | N/A | 6736 | 6755 | CACACACTATTCACTTAGGA | 20 | 19 | 923 |
| 1239201 | N/A | N/A | 6879 | 6898 | ACATTTATAATGCTTTTCAC | 61 | 64 | 924 |
| 1239223 | N/A | N/A | 7286 | 7305 | GAAGCTTAATTAGTTACATC | 15 | 15 | 925 |
| 1239245 | N/A | N/A | 7788 | 7807 | TGCAGTACCATATGTTGAAT | 27 | 28 | 926 |
| 1239267 | N/A | N/A | 8190 | 8209 | CAACATTAATTATCCCCCA | 67 | 77 | 927 |
| 1239289 | N/A | N/A | 8418 | 8437 | GCATTGTACCTCAACACAAT | 48 | 56 | 928 |
| 1239311 | N/A | N/A | 8805 | 8824 | CAAGTTTTTTTCTAAGCAT | 48 | 37 | 929 |
| 1239333 | N/A | N/A | 9078 | 9097 | TCAGTCAGAATTCAAAGGTA | 41 | 32 | 930 |
| 1239355 | N/A | N/A | 9423 | 9442 | TCTAGGTATAATTTTTTTAC | 83 | 86 | 931 |
| 1239377 | N/A | N/A | 9668 | 9687 | AAAGATTTTCTTCAGATGTT | 58 | 61 | 932 |
| 1239399 | N/A | N/A | 10126 | 10145 | GTCTGGGACTTCCATAACCA | 84 | 56 | 933 |
| 1239421 | N/A | N/A | 10737 | 10756 | TTAACACACATTTCAAGTGT | 94 | 61 | 934 |
| 1239443 | N/A | N/A | 11090 | 11109 | CAGTACCATAACCTTTTTTT | 58 | 49 | 935 |
| 1239465 | N/A | N/A | 12640 | 12659 | GACGGAAATATCATTCGACT | 43 | 50 | 936 |

TABLE 13-continued

Reduction of PRNP RNA

| Compound ID | SEQ ID NO: 1 Site | SEQ ID NO: 1 Site | SEQ ID NO: 2 Site | SEQ ID NO: 2 Site | Sequence (5' to 3') | PRNP (% UTC) RTS 42354 | PRNP (% UTC) RTS 42359 | SEQ ID NO |
|---|---|---|---|---|---|---|---|---|
| 1239487 | N/A | N/A | 13667 | 13686 | GCTAAGAATACACTCAGAAA | 51 | 47 | 937 |
| 1239509 | N/A | N/A | 13924 | 13943 | AGAGACACCTGAACAGGCGA | 100 | 95 | 938 |
| 1239531 | N/A | N/A | 14215 | 14234 | AGCATAAGGAATAATCAAAC | 62 | 64 | 939 |
| 1239553 | N/A | N/A | 14386 | 14405 | ATTATGTTATTTCCTCTGTG | 40 | 46 | 940 |
| 1239575 | N/A | N/A | 14822 | 14841 | CATGACCATCTTATTCGGTG | 58 | 56 | 941 |
| 1239597 | N/A | N/A | 14985 | 15004 | TTATGTCAGCACCTTCTCCA | 62 | 50 | 942 |
| 1239619 | N/A | N/A | 15275 | 15294 | TTCTACTAACATTATTGAAA | 94 | 64 | 943 |
| 1239641 | N/A | N/A | 15368 | 15387 | AATTATTTTTCATCTCCTTC | 56 | 57 | 944 |
| 1239663 | N/A | N/A | 15421 | 15440 | AAACCCCTTACCTTTATCAC | 74 | 100 | 945 |
| 1239685 | N/A | N/A | 15522 | 15541 | TAATTCACCATATACCATGT | 74 | 53 | 946 |
| 1239707 | N/A | N/A | 15700 | 15719 | CCAAATCATCACTGTGTGCC | 48 | 35 | 947 |
| 1239729 | N/A | N/A | 15773 | 15792 | GAGCAGAGACCTATGACAAT | 75 | 70 | 948 |
| 1239751 | N/A | N/A | 15835 | 15854 | CATCAAATCAAAAATCTCTT | 90 | 82 | 949 |
| 1239773 | N/A | N/A | 15884 | 15903 | GATCAAACATCCAGAATGAC | 57 | 64 | 950 |
| 1239795 | N/A | N/A | 15951 | 15970 | TAGTTCATTATTTAACATTT | 67 | 55 | 951 |

TABLE 14

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | PRNP (% UTC) RTS 42359 | SEQ ID NO |
|---|---|---|---|---|---|---|---|---|
| 1201142 | 1963 | 1982 | 17754 | 17773 | GCCACATATAGGGTCCTTTA | 8 | 17 | 66 |
| 1238124 | 55 | 74 | 3148 | 3167 | TAAAAATCATCTTTAATTGG | 91 | 92 | 952 |
| 1238146 | 122 | 141 | 3215 | 3234 | CTTGAACACTTGCATCAGTT | 89 | 74 | 953 |
| 1238168 | 510 | 529 | 16301 | 16320 | CAGTGTTCCATCCTCCAGGC | 6* | 58 | 954 |
| 1238190 | 595 619 | 614 638 | 16386 16410 | 16405 16429 | CCATGAGGCTGCCCCCAGCC | 75 | 226 | 955 |
| 1238212 | 931 | 950 | 16722 | 16741 | TTGTTCTGGTTGCTGTACTC | 54 | 44 | 956 |
| 1238234 | 1267 | 1286 | 17058 | 17077 | GAGTGAGACACCACCACTAA | 86 | 70 | 957 |
| 1238256 | 1442 | 1461 | 17233 | 17252 | CAGATTAACCAATGGTTATT | 37 | 60 | 958 |
| 1238278 | 1602 | 1621 | 17393 | 17412 | AAAATATCTCTAAATAGCTA | 88 | 66 | 959 |
| 1238300 | 1681 | 1700 | 17472 | 17491 | CTCTAGGATTTTTTTGAATA | 38 | 54 | 960 |
| 1238322 | 1813 | 1832 | 17604 | 17623 | GTGACAATATTTACTCTTGT | 3 | 8 | 961 |
| 1238344 | 1858 | 1877 | 17649 | 17668 | GTTATGTTCACTGTGAATAT | 14 | 16 | 962 |
| 1238366 | 1886 | 1905 | 17677 | 17696 | GTCCCAGAAGCCTTTCATAT | 28 | 31 | 963 |
| 1238388 | 1928 | 1947 | 17719 | 17738 | AGGTTGCCTCCAAGGGCACC | 92 | 83 | 964 |
| 1238410 | 2010 | 2029 | 17801 | 17820 | ATTTACTTTTCAGCTGCCTT | 10 | 21 | 965 |

TABLE 14 -continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | PRNP (% UTC) RTS 42359 | SEQ ID NO |
|---|---|---|---|---|---|---|---|---|
| 1238432 | 2059 | 2078 | 17850 | 17869 | TTTCCAGGTAAATGGACAAA | 43 | 44 | 966 |
| 1238454 | 2098 | 2117 | 17889 | 17908 | TCACAACTGCAGCTCTCCTG | 24 | 32 | 967 |
| 1238476 | 2129 | 2148 | 17920 | 17939 | AATTACATCATCCTCTATGA | 87 | 83 | 968 |
| 1238498 | 2157 | 2176 | 17948 | 17967 | TCTTTTCTTTGCACACTGAC | 9 | 23 | 969 |
| 1238520 | 2211 | 2230 | 18002 | 18021 | ACCTAATTCTGGTTTTTGAC | 41 | 41 | 970 |
| 1238542 | 2252 | 2271 | 18043 | 18062 | ATTCTTTGATTCAAAAGCCA | 26 | 44 | 971 |
| 1238564 | 2277 | 2296 | 18068 | 18087 | AAGATATTTTTTAGATTGTC | 56 | 44 | 972 |
| 1238586 | 2307 | 2326 | 18098 | 18117 | AATCAATCATATTTCTGTCA | 39 | 36 | 973 |
| 1238608 | 2340 | 2359 | 18131 | 18150 | ATTAACATTAACAGAATTTC | 93 | 77 | 974 |
| 1238630 | 2382 | 2401 | 18173 | 18192 | TAGGTGACAATATCAAACAA | 34 | 48 | 975 |
| 1238652 | 2441 | 2460 | 18232 | 18251 | TAGAATACTCACAAAGTGCA | 51 | 43 | 976 |
| 1238674 | 2538 | 2557 | 18329 | 18348 | GTTAATGCATTAGACACTTC | 25 | 32 | 977 |
| 1238696 | 2635 | 2654 | 18426 | 18445 | CTTTGGATTCTTACATGAAA | 50 | 57 | 978 |
| 1238718 | 2744 | 2763 | 18535 | 18554 | ATATTAAACATTTACAATTT | 104 | 84 | 979 |
| 1238740 | N/A | N/A | 4749 | 4768 | ACCGTGATGCTCTCAGAACA | 37 | 42 | 980 |
| 1238762 | N/A | N/A | 4830 | 4849 | AAATCCTTAATCCTATTCTA | 86 | 85 | 981 |
| 1238784 | N/A | N/A | 4878 | 4897 | TATTTATCCAATTCCCTGTT | 63 | 59 | 982 |
| 1238806 | N/A | N/A | 4925 | 4944 | TCTTCTACAAATCTAAGAGC | 85 | 73 | 983 |
| 1238828 | N/A | N/A | 4977 | 4996 | CTCTGTGTTTGTGTAAGTAA | 50 | 59 | 984 |
| 1238850 | N/A | N/A | 5047 | 5066 | TACAAATCACATCCTACCCC | 93 | 62 | 985 |
| 1238872 | N/A | N/A | 5102 | 5121 | ATAATCTTAATATTTTCCTT | 73 | 100 | 986 |
| 1238894 | N/A | N/A | 5134 | 5153 | TAAATGACTCATCATTTTGC | 63 | 56 | 987 |
| 1238916 | N/A | N/A | 5198 | 5217 | TTTTGGTTATTTTAATAGAT | 74 | 95 | 988 |
| 1238938 | N/A | N/A | 5383 | 5402 | GCTATCATTTCCTCCATTCT | 32 | 34 | 989 |
| 1238960 | N/A | N/A | 5455 | 5474 | GATTGCTTAACAAAATGTTT | 68 | 81 | 990 |
| 1238982 | N/A | N/A | 5584 | 5603 | GTGTTCTAATTTTAGATCAT | 46 | 48 | 991 |
| 1239004 | N/A | N/A | 5661 | 5680 | ATAATGTTCATTTCAGTTAA | 72 | 57 | 992 |
| 1239026 | N/A | N/A | 5714 | 5733 | TCAGTTTTTCCCCACATATC | 23 | 26 | 993 |
| 1239048 | N/A | N/A | 5785 | 5804 | CTTTCAGATTTTTCACATAT | 51 | 44 | 994 |
| 1239070 | N/A | N/A | 5890 | 5909 | CTGTGAACTATTTTTTAAAC | 29 | 64 | 995 |
| 1239092 | N/A | N/A | 6194 | 6213 | TAGATTTGTGCCTCCAGGAA | 33 | 33 | 996 |
| 1239114 | N/A | N/A | 6347 | 6366 | TCACACAGATGCACCCGAGT | 61 | 73 | 997 |
| 1239136 | N/A | N/A | 6445 | 6464 | CTCCCTTACATAATTCAGCA | 56 | 68 | 998 |
| 1239158 | N/A | N/A | 6562 | 6581 | AGAATCTTTCACCTTGGTTT | 33 | 41 | 999 |
| 1239180 | N/A | N/A | 6745 | 6764 | GAATTGCTGCACACACTATT | 72 | 106 | 1000 |
| 1239202 | N/A | N/A | 6884 | 6903 | CTTCAACATTTATAATGCTT | 38 | 36 | 1001 |

TABLE 14 -continued
Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | PRNP (% UTC) RTS 42359 | SEQ ID NO |
|---|---|---|---|---|---|---|---|---|
| 1239224 | N/A | N/A | 7290 | 7309 | ACTTGAAGCTTAATTAGTTA | 63 | 88 | 1002 |
| 1239246 | N/A | N/A | 7865 | 7884 | GGAACAATTTAACTTTTTCC | 50 | 62 | 1003 |
| 1239268 | N/A | N/A | 8191 | 8210 | ACAACATTAATTATCCCCCC | 66 | 67 | 1004 |
| 1239290 | N/A | N/A | 8419 | 8438 | AGCATTGTACCTCAACACAA | 50 | 43 | 1005 |
| 1239312 | N/A | N/A | 8806 | 8825 | TCAAGTTTTTTTCTAAGCA | 66 | 63 | 1006 |
| 1239334 | N/A | N/A | 9091 | 9110 | AGTAAACACAATTTCAGTCA | 30 | 57 | 1007 |
| 1239356 | N/A | N/A | 9425 | 9444 | CATCTAGGTATAATTTTTTT | 87 | 140 | 1008 |
| 1239378 | N/A | N/A | 9671 | 9690 | AGAAAAGATTTTCTTCAGAT | 73 | 60 | 1009 |
| 1239400 | N/A | N/A | 10197 | 10216 | TGAGACATATTTTACAGAAA | 55 | 43 | 1010 |
| 1239422 | N/A | N/A | 10738 | 10757 | CTTAACACACATTTCAAGTG | 56 | 80 | 1011 |
| 1239444 | N/A | N/A | 11106 | 11125 | TGTAATATAATATTTACAGT | 82 | 85 | 1012 |
| 1239466 | N/A | N/A | 12669 | 12688 | GAATTTGATTACATCCTCAA | 66 | 78 | 1013 |
| 1239488 | N/A | N/A | 13693 | 13712 | AATACCTGTTTATTACTAAG | 83 | 61 | 1014 |
| 1239510 | N/A | N/A | 13929 | 13948 | CTCTTAGAGACACCTGAACA | 89 | 73 | 1015 |
| 1239532 | N/A | N/A | 14228 | 14247 | ACACATGTTATAAAGCATAA | 58 | 70 | 1016 |
| 1239554 | N/A | N/A | 14391 | 14410 | GAGATATTATGTTATTTCCT | 27 | 26 | 1017 |
| 1239576 | N/A | N/A | 14834 | 14853 | CAATTTTTCCAACATGACCA | 56 | 47 | 1018 |
| 1239598 | N/A | N/A | 14993 | 15012 | AAGGGCTTTTATGTCAGCAC | 44 | 52 | 1019 |
| 1239620 | N/A | N/A | 15276 | 15295 | TTTCTACTAACATTATTGAA | 93 | 84 | 1020 |
| 1239642 | N/A | N/A | 15369 | 15388 | AAATTATTTTTCATCTCCTT | 50 | 70 | 1021 |
| 1239664 | N/A | N/A | 15424 | 15443 | CAGAAACCCCTTACCTTTAT | 63 | 69 | 1022 |
| 1239686 | N/A | N/A | 15524 | 15543 | TATAATTCACCATATACCAT | 62 | 84 | 1023 |
| 1239708 | N/A | N/A | 15701 | 15720 | TCCAAATCATCACTGTGTGC | 53 | 53 | 1024 |
| 1239730 | N/A | N/A | 15774 | 15793 | AGAGCAGAGACCTATGACAA | 87 | 77 | 1025 |
| 1239752 | N/A | N/A | 15836 | 15855 | TCATCAAATCAAAAATCTCT | 76 | 35 | 1026 |
| 1239774 | N/A | N/A | 15887 | 15906 | ACAGATCAAACATCCAGAAT | 59 | 49 | 1027 |
| 1239796 | N/A | N/A | 15955 | 15974 | CTTTTAGTTCATTATTTAAC | 73 | 64 | 1028 |

TABLE 15
Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 13 | 66 |
| 1238125 | 57 | 76 | 3150 | 3169 | TGTAAAAATCATCTTTAATT | 104 | 1029 |
| 1238147 | 123 | 142 | 3216 | 3235 | GCTTGAACACTTGCATCAGT | 59 | 1030 |

TABLE 15-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238169 | 512 | 531 | 16303 | 16322 | CCCAGTGTTCCATCCTCCAG | 9* | 1031 |
| 1238191 | 596 620 | 615 639 | 16387 16411 | 16406 16430 | ACCATGAGGCTGCCCCCAGC | 48 | 1032 |
| 1238213 | 966 | 985 | 16757 | 16776 | GCTTGATTGTGATATTGACG | 52 | 1033 |
| 1238235 | 1269 | 1288 | 17060 | 17079 | AAGAGTGAGACACCACCACT | 62 | 1034 |
| 1238257 | 1444 | 1463 | 17235 | 17254 | TCCAGATTAACCAATGGTTA | 41 | 1035 |
| 1238279 | 1605 | 1624 | 17396 | 17415 | TGGAAAATATCTCTAAATAG | 78 | 1036 |
| 1238301 | 1691 | 1710 | 17482 | 17501 | AGCTAAGAATCTCTAGGATT | 31 | 1037 |
| 1238323 | 1814 | 1833 | 17605 | 17624 | TGTGACAATATTTACTCTTG | 10 | 1038 |
| 1238345 | 1859 | 1878 | 17650 | 17669 | AGTTATGTTCACTGTGAATA | 17 | 1039 |
| 1238367 | 1893 | 1912 | 17684 | 17703 | ATTTCAAGTCCCAGAAGCCT | 34 | 1040 |
| 1238389 | 1929 | 1948 | 17720 | 17739 | GAGGTTGCCTCCAAGGGCAC | 83 | 1041 |
| 1238411 | 2012 | 2031 | 17803 | 17822 | CAATTTACTTTTCAGCTGCC | 32 | 1042 |
| 1238433 | 2060 | 2079 | 17851 | 17870 | GTTTCCAGGTAAATGGACAA | 77 | 1043 |
| 1238455 | 2101 | 2120 | 17892 | 17911 | CTTTCACAACTGCAGCTCTC | 30 | 1044 |
| 1238477 | 2131 | 2150 | 17922 | 17941 | TTAATTACATCATCCTCTAT | 93 | 1045 |
| 1238499 | 2158 | 2177 | 17949 | 17968 | TTCTTTTCTTTGCACACTGA | 15 | 1046 |
| 1238521 | 2212 | 2231 | 18003 | 18022 | GACCTAATTCTGGTTTTTGA | 56 | 1047 |
| 1238543 | 2253 | 2272 | 18044 | 18063 | TATTCTTTGATTCAAAAGCC | 50 | 1048 |
| 1238565 | 2279 | 2298 | 18070 | 18089 | CTAAGATATTTTTTAGATTG | 78 | 1049 |
| 1238587 | 2308 | 2327 | 18099 | 18118 | AAATCAATCATATTTCTGTC | 51 | 1050 |
| 1238609 | 2342 | 2361 | 18133 | 18152 | TAATTAACATTAACAGAATT | 92 | 1051 |
| 1238631 | 2383 | 2402 | 18174 | 18193 | CTAGGTGACAATATCAAACA | 29 | 1052 |
| 1238653 | 2442 | 2461 | 18233 | 18252 | ATAGAATACTCACAAAGTGC | 41 | 1053 |
| 1238675 | 2539 | 2558 | 18330 | 18349 | AGTTAATGCATTAGACACTT | 24 | 1054 |
| 1238697 | 2636 | 2655 | 18427 | 18446 | ACTTTGGATTCTTACATGAA | 54 | 1055 |
| 1238719 | 2745 | 2764 | 18536 | 18555 | GATATTAAACATTTACAATT | 92 | 1056 |
| 1238741 | N/A | N/A | 4751 | 4770 | AAACCGTGATGCTCTCAGAA | 30 | 1057 |
| 1238763 | N/A | N/A | 4831 | 4850 | AAAATCCTTAATCCTATTCT | 102 | 1058 |
| 1238785 | N/A | N/A | 4879 | 4898 | ATATTTATCCAATTCCCTGT | 46 | 1059 |
| 1238807 | N/A | N/A | 4929 | 4948 | CCTTTCTTCTACAAATCTAA | 71 | 1060 |
| 1238829 | N/A | N/A | 4988 | 5007 | TGTAAGACCTTCTCTGTGTT | 66 | 1061 |
| 1238851 | N/A | N/A | 5049 | 5068 | CATACAAATCACATCCTACC | 80 | 1062 |
| 1238873 | N/A | N/A | 5103 | 5122 | TATAATCTTAATATTTTCCT | 110 | 1063 |
| 1238895 | N/A | N/A | 5136 | 5155 | TGTAAATGACTCATCATTTT | 58 | 1064 |
| 1238917 | N/A | N/A | 5209 | 5228 | ACTATTAATTATTTTGGTTA | 76 | 1065 |
| 1238939 | N/A | N/A | 5384 | 5403 | AGCTATCATTTCCTCCATTC | 31 | 1066 |

TABLE 15-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238961 | N/A | N/A | 5456 | 5475 | AGATTGCTTAACAAAATGTT | 86 | 1067 |
| 1238983 | N/A | N/A | 5585 | 5604 | GGTGTTCTAATTTTAGATCA | 33 | 1068 |
| 1239005 | N/A | N/A | 5662 | 5681 | CATAATGTTCATTTCAGTTA | 45 | 1069 |
| 1239027 | N/A | N/A | 5716 | 5735 | TGTCAGTTTTTCCCCACATA | 16 | 1070 |
| 1239049 | N/A | N/A | 5786 | 5805 | CCTTTCAGATTTTTCACATA | 41 | 1071 |
| 1239071 | N/A | N/A | 5919 | 5938 | TGGGTCCATTTCATCTAAAA | 60 | 1072 |
| 1239093 | N/A | N/A | 6207 | 6226 | GGTTCAGCTAAACTAGATTT | 28 | 1073 |
| 1239115 | N/A | N/A | 6355 | 6374 | GGTGTCAGTCACACAGATGC | 81 | 1074 |
| 1239137 | N/A | N/A | 6447 | 6466 | TGCTCCCTTACATAATTCAG | 81 | 1075 |
| 1239159 | N/A | N/A | 6563 | 6582 | GAGAATCTTTCACCTTGGTT | 45 | 1076 |
| 1239181 | N/A | N/A | 6752 | 6771 | GCTGTGAGAATTGCTGCACA | 78 | 1077 |
| 1239203 | N/A | N/A | 6886 | 6905 | ATCTTCAACATTTATAATGC | 64 | 1078 |
| 1239225 | N/A | N/A | 7302 | 7321 | AAACACATTACAACTTGAAG | 58 | 1079 |
| 1239247 | N/A | N/A | 8024 | 8043 | TATTTCTTTCCTGATAGTTC | 32 | 1080 |
| 1239269 | N/A | N/A | 8192 | 8211 | AACAACATTAATTATCCCCC | 67 | 1081 |
| 1239291 | N/A | N/A | 8420 | 8439 | AAGCATTGTACCTCAACACA | 67 | 1082 |
| 1239313 | N/A | N/A | 8807 | 8826 | ATCAAGTTTTTTTCTAAGC | 39 | 1083 |
| 1239335 | N/A | N/A | 9106 | 9125 | GCAAATAATCTACAAAGTAA | 93 | 1084 |
| 1239357 | N/A | N/A | 9434 | 9453 | CTATAAATTCATCTAGGTAT | 59 | 1085 |
| 1239379 | N/A | N/A | 9695 | 9714 | AGGAGCTCTATTAATAGGTT | 47 | 1086 |
| 1239401 | N/A | N/A | 10198 | 10217 | ATGAGACATATTTTACAGAA | 47 | 1087 |
| 1239423 | N/A | N/A | 10739 | 10758 | GCTTAACACACATTTCAAGT | 38 | 1088 |
| 1239445 | N/A | N/A | 11125 | 11144 | GCTGTCAAAAATTATACACT | 48 | 1089 |
| 1239467 | N/A | N/A | 12670 | 12689 | TGAATTTGATTACATCCTCA | 70 | 1090 |
| 1239489 | N/A | N/A | 13694 | 13713 | CAATACCTGTTTATTACTAA | 56 | 1091 |
| 1239511 | N/A | N/A | 13936 | 13955 | CTATGAGCTCTTAGAGACAC | 79 | 1092 |
| 1239533 | N/A | N/A | 14235 | 14254 | TGGGAAAACACATGTTATAA | 70 | 1093 |
| 1239555 | N/A | N/A | 14393 | 14412 | TTGAGATATTATGTTATTTC | 76 | 1094 |
| 1239577 | N/A | N/A | 14835 | 14854 | TCAATTTTTCCAACATGACC | 71 | 1095 |
| 1239599 | N/A | N/A | 14994 | 15013 | AAAGGGCTTTTATGTCAGCA | 25 | 1096 |
| 1239621 | N/A | N/A | 15283 | 15302 | GTTTATGTTTCTACTAACAT | 72 | 1097 |
| 1239643 | N/A | N/A | 15370 | 15389 | AAAATTATTTTTCATCTCCT | 79 | 1098 |
| 1239665 | N/A | N/A | 15425 | 15444 | TCAGAAACCCCTTACCTTTA | 87 | 1099 |
| 1239687 | N/A | N/A | 15525 | 15544 | ATATAATTCACCATATACCA | 69 | 1100 |
| 1239709 | N/A | N/A | 15703 | 15722 | GCTCCAAATCATCACTGTGT | 47 | 1101 |
| 1239731 | N/A | N/A | 15775 | 15794 | AAGAGCAGAGACCTATGACA | 98 | 1102 |

TABLE 15-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239753 | N/A | N/A | 15837 | 15856 | TTCATCAAATCAAAAATCTC | 106 | 1103 |
| 1239775 | N/A | N/A | 15888 | 15907 | AACAGATCAAACATCCAGAA | 67 | 1104 |
| 1239797 | N/A | N/A | 15960 | 15979 | AATGACTTTTAGTTCATTAT | 91 | 1105 |

TABLE 16

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1201142 | 1963 | 1982 | 17754 | 17773 | GCCACATATAGGGTCCTTTA | 11 | 66 |
| 1238126 | 58 | 77 | 3151 | 3170 | CTGTAAAAATCATCTTTAAT | 119 | 1106 |
| 1238148 | 124 | 143 | 3217 | 3236 | CGCTTGAACACTTGCATCAG | 113 | 1107 |
| 1238170 | 513 | 532 | 16304 | 16323 | CCCCAGTGTTCCATCCTCCA | 7* | 1108 |
| 1238192 | 603 627 | 622 646 | 16394 16418 | 16413 16437 | AGCCACCACCATGAGGCTGC | 77 | 1109 |
| 1238214 | 1002 | 1021 | 16793 | 16812 | AGTTCTCCCCCTTGGTGGTT | 63 | 1110 |
| 1238236 | 1270 | 1289 | 17061 | 17080 | AAAGAGTGAGACACCACCAC | 67 | 1111 |
| 1238258 | 1451 | 1470 | 17242 | 17261 | AAATAAGTCCAGATTAACCA | 62 | 1112 |
| 1238280 | 1607 | 1626 | 17398 | 17417 | AATGGAAAATATCTCTAAAT | 95 | 1113 |
| 1238302 | 1692 | 1711 | 17483 | 17502 | GAGCTAAGAATCTCTAGGAT | 22 | 1114 |
| 1238324 | 1815 | 1834 | 17606 | 17625 | TTGTGACAATATTTACTCTT | 10 | 1115 |
| 1238346 | 1860 | 1879 | 17651 | 17670 | CAGTTATGTTCACTGTGAAT | 26 | 1116 |
| 1238368 | 1896 | 1915 | 17687 | 17706 | TTGATTTCAAGTCCCAGAAG | 26 | 1117 |
| 1238390 | 1933 | 1952 | 17724 | 17743 | ATGGGAGGTTGCCTCCAAGG | 108 | 1118 |
| 1238412 | 2013 | 2032 | 17804 | 17823 | GCAATTTACTTTTCAGCTGC | 40 | 1119 |
| 1238434 | 2062 | 2081 | 17853 | 17872 | TGGTTTCCAGGTAAATGGAC | 47 | 1120 |
| 1238456 | 2102 | 2121 | 17893 | 17912 | GCTTTCACAACTGCAGCTCT | 48 | 1121 |
| 1238478 | 2132 | 2151 | 17923 | 17942 | TTTAATTACATCATCCTCTA | 85 | 1122 |
| 1238500 | 2159 | 2178 | 17950 | 17969 | GTTCTTTTCTTTGCACACTG | 5 | 1123 |
| 1238522 | 2215 | 2234 | 18006 | 18025 | CTTGACCTAATTCTGGTTTT | 79 | 1124 |
| 1238544 | 2254 | 2273 | 18045 | 18064 | CTATTCTTTGATTCAAAAGC | 94 | 1125 |
| 1238566 | 2280 | 2299 | 18071 | 18090 | CCTAAGATATTTTTTAGATT | 87 | 1126 |
| 1238588 | 2310 | 2329 | 18101 | 18120 | TCAAATCAATCATATTTCTG | 88 | 1127 |
| 1238610 | 2346 | 2365 | 18137 | 18156 | ACTTTAATTAACATTAACAG | 105 | 1128 |
| 1238632 | 2384 | 2403 | 18175 | 18194 | GCTAGGTGACAATATCAAAC | 10 | 1129 |
| 1238654 | 2444 | 2463 | 18235 | 18254 | ACATGAATACTCACAAAGT | 85 | 1130 |
| 1238676 | 2542 | 2561 | 18333 | 18352 | AAAAGTTAATGCATTAGACA | 90 | 1131 |

TABLE 16-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1238698 | 2647 | 2666 | 18438 | 18457 | TAATGGTGTCCACTTTGGAT | 40 | 1132 |
| 1238720 | 2746 | 2765 | 18537 | 18556 | AGATATTAAACATTTACAAT | 104 | 1133 |
| 1238742 | N/A | N/A | 4762 | 4781 | AACTGCTAATTAAACCGTGA | 35 | 1134 |
| 1238764 | N/A | N/A | 4832 | 4851 | AAAAATCCTTAATCCTATTC | 99 | 1135 |
| 1238786 | N/A | N/A | 4880 | 4899 | CATATTTATCCAATTCCCTG | 86 | 1136 |
| 1238808 | N/A | N/A | 4931 | 4950 | TTCCTTTCTTCTACAAATCT | 84 | 1137 |
| 1238830 | N/A | N/A | 4989 | 5008 | CTGTAAGACCTTCTCTGTGT | 52 | 1138 |
| 1238852 | N/A | N/A | 5050 | 5069 | ACATACAAATCACATCCTAC | 87 | 1139 |
| 1238874 | N/A | N/A | 5104 | 5123 | TTATAATCTTAATATTTTCC | 91 | 1140 |
| 1238896 | N/A | N/A | 5137 | 5156 | GTGTAAATGACTCATCATTT | 11 | 1141 |
| 1238918 | N/A | N/A | 5210 | 5229 | TACTATTAATTATTTTGGTT | 119 | 1142 |
| 1238940 | N/A | N/A | 5385 | 5404 | TAGCTATCATTTCCTCCATT | 43 | 1143 |
| 1238962 | N/A | N/A | 5457 | 5476 | CAGATTGCTTAACAAAATGT | 78 | 1144 |
| 1238984 | N/A | N/A | 5586 | 5605 | AGGTGTTCTAATTTTAGATC | 22 | 1145 |
| 1239006 | N/A | N/A | 5663 | 5682 | ACATAATGTTCATTTCAGTT | 20 | 1146 |
| 1239028 | N/A | N/A | 5717 | 5736 | TTGTCAGTTTTTCCCCACAT | 15 | 1147 |
| 1239050 | N/A | N/A | 5788 | 5807 | TTCCTTTCAGATTTTTCACA | 62 | 1148 |
| 1239072 | N/A | N/A | 5922 | 5941 | CTGTGGGTCCATTTCATCTA | 29 | 1149 |
| 1239094 | N/A | N/A | 6227 | 6246 | GGATATGTACAATCTGTTGT | 33 | 1150 |
| 1239116 | N/A | N/A | 6372 | 6391 | AAATGATGATGCAATGAGGT | 35 | 1151 |
| 1239138 | N/A | N/A | 6453 | 6472 | AATGGCTGCTCCCTTACATA | 36 | 1152 |
| 1239160 | N/A | N/A | 6564 | 6583 | AGAGAATCTTTCACCTTGGT | 55 | 1153 |
| 1239182 | N/A | N/A | 6773 | 6792 | TCGACAAAAAAAATTCTCCT | 101 | 1154 |
| 1239204 | N/A | N/A | 6889 | 6908 | CTAATCTTCAACATTTATAA | 101 | 1155 |
| 1239226 | N/A | N/A | 7307 | 7326 | CCATAAAACACATTACAACT | 82 | 1156 |
| 1239248 | N/A | N/A | 8026 | 8045 | TTTATTTCTTTCCTGATAGT | 81 | 1157 |
| 1239270 | N/A | N/A | 8193 | 8212 | TAACAACATTAATTATCCCC | 61 | 1158 |
| 1239292 | N/A | N/A | 8422 | 8441 | AGAAGCATTGTACCTCAACA | 42 | 1159 |
| 1239314 | N/A | N/A | 8808 | 8827 | TATCAAGTTTTTTTTCTAAG | 86 | 1160 |
| 1239336 | N/A | N/A | 9108 | 9127 | CAGCAAATAATCTACAAAGT | 83 | 1161 |
| 1239358 | N/A | N/A | 9435 | 9454 | TCTATAAATTCATCTAGGTA | 59 | 1162 |
| 1239380 | N/A | N/A | 9707 | 9726 | TGGTTGAAAATCAGGAGCTC | 42 | 1163 |
| 1239402 | N/A | N/A | 10338 | 10357 | GTCTACAAAACATTTTTTCT | 71 | 1164 |
| 1239424 | N/A | N/A | 10741 | 10760 | TAGCTTAACACACATTTCAA | 52 | 1165 |
| 1239446 | N/A | N/A | 11204 | 11223 | CAGCCAGTATGTGTCAGCTT | 67 | 1166 |
| 1239468 | N/A | N/A | 12672 | 12691 | GATGAATTTGATTACATCCT | 61 | 1167 |
| 1239490 | N/A | N/A | 13696 | 13715 | GTCAATACCTGTTTATTACT | 63 | 1168 |

TABLE 16-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239512 | N/A | N/A | 13938 | 13957 | ATCTATGAGCTCTTAGAGAC | 76 | 1169 |
| 1239534 | N/A | N/A | 14238 | 14257 | GAATGGGAAAACACATGTTA | 63 | 1170 |
| 1239556 | N/A | N/A | 14394 | 14413 | CTTGAGATATTATGTTATTT | 79 | 1171 |
| 1239578 | N/A | N/A | 14836 | 14855 | CTCAATTTTTCCAACATGAC | 64 | 1172 |
| 1239600 | N/A | N/A | 14997 | 15016 | TCTAAAGGGCTTTTATGTCA | 80 | 1173 |
| 1239622 | N/A | N/A | 15284 | 15303 | TGTTTATGTTTCTACTAACA | 83 | 1174 |
| 1239644 | N/A | N/A | 15371 | 15390 | GAAAATTATTTTTCATCTCC | 104 | 1175 |
| 1239666 | N/A | N/A | 15426 | 15445 | CTCAGAAACCCCTTACCTTT | 68 | 1176 |
| 1239688 | N/A | N/A | 15526 | 15545 | CATATAATTCACCATATACC | 66 | 1177 |
| 1239710 | N/A | N/A | 15704 | 15723 | GGCTCCAAATCATCACTGTG | 71 | 1178 |
| 1239732 | N/A | N/A | 15786 | 15805 | CACTTAGCTCCAAGAGCAGA | 94 | 1179 |
| 1239754 | N/A | N/A | 15839 | 15858 | CATTCATCAAATCAAAAATC | 89 | 1180 |
| 1239776 | N/A | N/A | 15889 | 15908 | AAACAGATCAAACATCCAGA | 52 | 1181 |
| 1239798 | N/A | N/A | 15961 | 15980 | GAATGACTTTTAGTTCATTA | 89 | 1182 |

TABLE 17

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 8 | 66 |
| 1238127 | 59 | 78 | 3152 | 3171 | ACTGTAAAAATCATCTTTAA | 92 | 1183 |
| 1238149 | 125 | 144 | 3218 | 3237 | TCGCTTGAACACTTGCATCA | 82 | 1184 |
| 1238171 | 521 | 540 | 16312 | 16331 | TCGGCTGCCCCCAGTGTTCC | 43* | 1185 |
| 1238193 | 604 | 623 | 16395 | 16414 | CAGCCACCACCATGAGGCTG | 82 | 1186 |
|  | 628 | 647 | 16419 | 16438 |  |  |  |
|  | 676 | 695 | 16467 | 16486 |  |  |  |
| 1238215 | 1005 | 1024 | 16796 | 16815 | TGAAGTTCTCCCCCTTGGTG | 78 | 1187 |
| 1238237 | 1300 | 1319 | 17091 | 17110 | TGATTAGCCTATCCGGGACA | 55 | 1188 |
| 1238259 | 1457 | 1476 | 17248 | 17267 | GTCCAAAAATAAGTCCAGAT | 4 | 1189 |
| 1238281 | 1611 | 1630 | 17402 | 17421 | TTAAAATGGAAAATATCTCT | 96 | 1190 |
| 1238303 | 1693 | 1712 | 17484 | 17503 | AGAGCTAAGAATCTCTAGGA | 40 | 1191 |
| 1238325 | 1816 | 1835 | 17607 | 17626 | GTTGTGACAATATTTACTCT | 5 | 1192 |
| 1238347 | 1862 | 1881 | 17653 | 17672 | TACAGTTATGTTCACTGTGA | 80 | 1193 |
| 1238369 | 1897 | 1916 | 17688 | 17707 | TTTGATTTCAAGTCCCAGAA | 10 | 1194 |
| 1238391 | 1947 | 1966 | 17738 | 17757 | TTTAAACATCTAAAATGGGA | 87 | 1195 |
| 1238413 | 2014 | 2033 | 17805 | 17824 | GGCAATTTACTTTTCAGCTG | 42 | 1196 |

TABLE 17-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238435 | 2068 | 2087 | 17859 | 17878 | TCATTCTGGTTTCCAGGTAA | 16 | 1197 |
| 1238457 | 2103 | 2122 | 17894 | 17913 | TGCTTTCACAACTGCAGCTC | 75 | 1198 |
| 1238479 | 2133 | 2152 | 17924 | 17943 | TTTTAATTACATCATCCTCT | 100 | 1199 |
| 1238501 | 2160 | 2179 | 17951 | 17970 | AGTTCTTTTCTTTGCACACT | 6 | 1200 |
| 1238523 | 2216 | 2235 | 18007 | 18026 | ACTTGACCTAATTCTGGTTT | 30 | 1201 |
| 1238545 | 2255 | 2274 | 18046 | 18065 | CCTATTCTTTGATTCAAAAG | 71 | 1202 |
| 1238567 | 2281 | 2300 | 18072 | 18091 | ACCTAAGATATTTTTAGAT | 127 | 1203 |
| 1238589 | 2311 | 2330 | 18102 | 18121 | TTCAAATCAATCATATTTCT | 79 | 1204 |
| 1238611 | 2347 | 2366 | 18138 | 18157 | TACTTTAATTAACATTAACA | 94 | 1205 |
| 1238633 | 2385 | 2404 | 18176 | 18195 | TGCTAGGTGACAATATCAAA | 22 | 1206 |
| 1238655 | 2446 | 2465 | 18237 | 18256 | TTACATAGAATACTCACAAA | 67 | 1207 |
| 1238677 | 2547 | 2566 | 18338 | 18357 | CTTACAAAAGTTAATGCATT | 73 | 1208 |
| 1238699 | 2669 | 2688 | 18460 | 18479 | CATGCATATTTCAAAGACCT | 41 | 1209 |
| 1238721 | 2747 | 2766 | 18538 | 18557 | CAGATATTAAACATTTACAA | 98 | 1210 |
| 1238743 | N/A | N/A | 4763 | 4782 | GAACTGCTAATTAAACCGTG | 62 | 1211 |
| 1238765 | N/A | N/A | 4834 | 4853 | GTAAAAATCCTTAATCCTAT | 110 | 1212 |
| 1238787 | N/A | N/A | 4881 | 4900 | ACATATTTATCCAATTCCCT | 87 | 1213 |
| 1238809 | N/A | N/A | 4934 | 4953 | TTTTTCCTTTCTTCTACAAA | 88 | 1214 |
| 1238831 | N/A | N/A | 4990 | 5009 | ACTGTAAGACCTTCTCTGTG | 68 | 1215 |
| 1238853 | N/A | N/A | 5051 | 5070 | AACATACAAATCACATCCTA | 63 | 1216 |
| 1238875 | N/A | N/A | 5107 | 5126 | CTATTATAATCTTAATATTT | 102 | 1217 |
| 1238897 | N/A | N/A | 5139 | 5158 | TTGTGTAAATGACTCATCAT | 59 | 1218 |
| 1238919 | N/A | N/A | 5211 | 5230 | TTACTATTAATTATTTTGGT | 67 | 1219 |
| 1238941 | N/A | N/A | 5387 | 5406 | AGTAGCTATCATTTCCTCCA | 27 | 1220 |
| 1238963 | N/A | N/A | 5461 | 5480 | TCACCAGATTGCTTAACAAA | 73 | 1221 |
| 1238985 | N/A | N/A | 5587 | 5606 | CAGGTGTTCTAATTTTAGAT | 38 | 1222 |
| 1239007 | N/A | N/A | 5664 | 5683 | TACATAATGTTCATTTCAGT | 44 | 1223 |
| 1239029 | N/A | N/A | 5718 | 5737 | CTTGTCAGTTTTCCCCACA | 18 | 1224 |
| 1239051 | N/A | N/A | 5792 | 5811 | GCTTTTCCTTTCAGATTTTT | 15 | 1225 |
| 1239073 | N/A | N/A | 5923 | 5942 | ACTGTGGGTCCATTTCATCT | 22 | 1226 |
| 1239095 | N/A | N/A | 6229 | 6248 | CAGGATATGTACAATCTGTT | 37 | 1227 |
| 1239117 | N/A | N/A | 6386 | 6405 | GCTGATTTTACAAGAAATGA | 46 | 1228 |
| 1239139 | N/A | N/A | 6472 | 6491 | TTGATTACATTATTTTTAAA | 94 | 1229 |
| 1239161 | N/A | N/A | 6567 | 6586 | TTCAGAGAATCTTTCACCTT | 53 | 1230 |
| 1239183 | N/A | N/A | 6785 | 6804 | ATGGTTAACACATCGACAAA | 80 | 1231 |
| 1239205 | N/A | N/A | 6892 | 6911 | GGTCTAATCTTCAACATTTA | 75 | 1232 |
| 1239227 | N/A | N/A | 7309 | 7328 | GCCCATAAAACACATTACAA | 61 | 1233 |

TABLE 17-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239249 | N/A | N/A | 8029 | 8048 | CTTTTTATTTCTTTCCTGAT | 62 | 1234 |
| 1239271 | N/A | N/A | 8194 | 8213 | TTAACAACATTAATTATCCC | 112 | 1235 |
| 1239293 | N/A | N/A | 8425 | 8444 | TGTAGAAGCATTGTACCTCA | 16 | 1236 |
| 1239315 | N/A | N/A | 8809 | 8828 | GTATCAAGTTTTTTTCTAA | 39 | 1237 |
| 1239337 | N/A | N/A | 9109 | 9128 | CCAGCAAATAATCTACAAAG | 86 | 1238 |
| 1239359 | N/A | N/A | 9438 | 9457 | TGTTCTATAAATTCATCTAG | 41 | 1239 |
| 1239381 | N/A | N/A | 9711 | 9730 | AGAATGGTTGAAAATCAGGA | 37 | 1240 |
| 1239403 | N/A | N/A | 10464 | 10483 | ATCATAGAATGTTTTTTCAA | 86 | 1241 |
| 1239425 | N/A | N/A | 10742 | 10761 | TTAGCTTAACACACATTTCA | 47 | 1242 |
| 1239447 | N/A | N/A | 11335 | 11354 | TTGTTGTTTCTTTTCTGGTA | 21 | 1243 |
| 1239469 | N/A | N/A | 12718 | 12737 | GGAAGAACTTTTTAAACAAA | 81 | 1244 |
| 1239491 | N/A | N/A | 13698 | 13717 | TGGTCAATACCTGTTTATTA | 43 | 1245 |
| 1239513 | N/A | N/A | 13974 | 13993 | TTGAATGTGCCTCATTTAAA | 98 | 1246 |
| 1239535 | N/A | N/A | 14239 | 14258 | TGAATGGGAAAACACATGTT | 82 | 1247 |
| 1239557 | N/A | N/A | 14395 | 14414 | ACTTGAGATATTATGTTATT | 71 | 1248 |
| 1239579 | N/A | N/A | 14839 | 14858 | CTTCTCAATTTTTCCAACAT | 84 | 1249 |
| 1239601 | N/A | N/A | 15011 | 15030 | TCAGTAGCTTTCAGTCTAAA | 67 | 1250 |
| 1239623 | N/A | N/A | 15285 | 15304 | CTGTTTATGTTTCTACTAAC | 55 | 1251 |
| 1239645 | N/A | N/A | 15373 | 15392 | TAGAAAATTATTTTTCATCT | 111 | 1252 |
| 1239667 | N/A | N/A | 15427 | 15446 | ACTCAGAAACCCCTTACCTT | 84 | 1253 |
| 1239689 | N/A | N/A | 15527 | 15546 | CCATATAATTCACCATATAC | 71 | 1254 |
| 1239711 | N/A | N/A | 15706 | 15725 | TAGGCTCCAAATCATCACTG | 40 | 1255 |
| 1239733 | N/A | N/A | 15791 | 15810 | CTGGGCACTTAGCTCCAAGA | 117 | 1256 |
| 1239755 | N/A | N/A | 15840 | 15859 | ACATTCATCAAATCAAAAAT | 116 | 1257 |
| 1239777 | N/A | N/A | 15890 | 15909 | CAAACAGATCAAACATCCAG | 96 | 1258 |
| 1239799 | N/A | N/A | 15962 | 15981 | TGAATGACTTTTAGTTCATT | 85 | 1259 |

TABLE 18

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1201142 | 1963 | 1982 | 17754 | 17773 | GCCACATATAGGGTCCTTTA | 9 | 66 |
| 1238128 | 60 | 79 | 3153 | 3172 | GACTGTAAAAATCATCTTTA | 79 | 1260 |
| 1238150 | 127 | 146 | 3220 | 3239 | ATTCGCTTGAACACTTGCAT | 84 | 1261 |
| 1238172 | 584 | 603 | 16375 | 16394 | CCCCCAGCCACCACCGCCCT | 79 | 1262 |

TABLE 18-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1238194 | 659 | 678 | 16450 | 16469 | CTGTCCCCAGCCACCACCAT | 51 | 1263 |
| 1238216 | 1036 | 1055 | 16827 | 16846 | ACGCGCTCCATCATCTTAAC | 67 | 1264 |
| 1238238 | 1301 | 1320 | 17092 | 17111 | TTGATTAGCCTATCCGGGAC | 77 | 1265 |
| 1238260 | 1460 | 1479 | 17251 | 17270 | TAAGTCCAAAAATAAGTCCA | 57 | 1266 |
| 1238282 | 1612 | 1631 | 17403 | 17422 | CTTAAAATGGAAAATATCTC | 99 | 1267 |
| 1238304 | 1753 | 1772 | 17544 | 17563 | ATCACCCCAGTTCTCGGTAC | 88 | 1268 |
| 1238326 | 1817 | 1836 | 17608 | 17627 | TGTTGTGACAATATTTACTC | 36 | 1269 |
| 1238348 | 1863 | 1882 | 17654 | 17673 | TTACAGTTATGTTCACTGTG | 70 | 1270 |
| 1238370 | 1898 | 1917 | 17689 | 17708 | ATTTGATTTCAAGTCCCAGA | 3 | 1271 |
| 1238392 | 1951 | 1970 | 17742 | 17761 | GTCCTTTAAACATCTAAAAT | 76 | 1272 |
| 1238414 | 2015 | 2034 | 17806 | 17825 | AGGCAATTTACTTTTCAGCT | 35 | 1273 |
| 1238436 | 2069 | 2088 | 17860 | 17879 | ATCATTCTGGTTTCCAGGTA | 15 | 1274 |
| 1238458 | 2104 | 2123 | 17895 | 17914 | GTGCTTTCACAACTGCAGCT | 40 | 1275 |
| 1238480 | 2134 | 2153 | 17925 | 17944 | TTTTTAATTACATCATCCTC | 93 | 1276 |
| 1238502 | 2161 | 2180 | 17952 | 17971 | CAGTTCTTTTCTTTGCACAC | 13 | 1277 |
| 1238524 | 2217 | 2236 | 18008 | 18027 | AACTTGACCTAATTCTGGTT | 80 | 1278 |
| 1238546 | 2256 | 2275 | 18047 | 18066 | CCCTATTCTTTGATTCAAAA | 45 | 1279 |
| 1238568 | 2287 | 2306 | 18078 | 18097 | TCTCCAACCTAAGATATTTT | 62 | 1280 |
| 1238590 | 2312 | 2331 | 18103 | 18122 | CTTCAAATCAATCATATTTC | 68 | 1281 |
| 1238612 | 2348 | 2367 | 18139 | 18158 | TTACTTTAATTAACATTAAC | 76 | 1282 |
| 1238634 | 2386 | 2405 | 18177 | 18196 | CTGCTAGGTGACAATATCAA | 30 | 1283 |
| 1238656 | 2448 | 2467 | 18239 | 18258 | TTTTACATAGAATACTCACA | 51 | 1284 |
| 1238678 | 2550 | 2569 | 18341 | 18360 | TACCTTACAAAAGTTAATGC | 59 | 1285 |
| 1238700 | 2670 | 2689 | 18461 | 18480 | ACATGCATATTTCAAAGACC | 37 | 1286 |
| 1238722 | 2748 | 2767 | 18539 | 18558 | TCAGATATTAAACATTTACA | 76 | 1287 |
| 1238744 | N/A | N/A | 4784 | 4803 | AAACACTTCAAATCATATGG | 84 | 1288 |
| 1238766 | N/A | N/A | 4835 | 4854 | TGTAAAAATCCTTAATCCTA | 77 | 1289 |
| 1238788 | N/A | N/A | 4882 | 4901 | AACATATTTATCCAATTCCC | 73 | 1290 |
| 1238810 | N/A | N/A | 4937 | 4956 | GATTTTTTCCTTTCTTCTAC | 52 | 1291 |
| 1238832 | N/A | N/A | 4993 | 5012 | TTCACTGTAAGACCTTCTCT | 40 | 1292 |
| 1238854 | N/A | N/A | 5052 | 5071 | TAACATACAAATCACATCCT | 85 | 1293 |
| 1238876 | N/A | N/A | 5108 | 5127 | TCTATTATAATCTTAATATT | 104 | 1294 |
| 1238898 | N/A | N/A | 5144 | 5163 | TTTTATTGTGTAAATGACTC | 66 | 1295 |
| 1238920 | N/A | N/A | 5215 | 5234 | GCTGTTACTATTAATTATTT | 54 | 1296 |
| 1238942 | N/A | N/A | 5388 | 5407 | AAGTAGCTATCATTTCCTCC | 44 | 1297 |
| 1238964 | N/A | N/A | 5462 | 5481 | ATCACCAGATTGCTTAACAA | 69 | 1298 |
| 1238986 | N/A | N/A | 5591 | 5610 | TTTCCAGGTGTTCTAATTTT | 57 | 1299 |

TABLE 18-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1239008 | N/A | N/A | 5666 | 5685 | GTTACATAATGTTCATTTCA | 19 | 1300 |
| 1239030 | N/A | N/A | 5719 | 5738 | ACTTGTCAGTTTTTCCCCAC | 20 | 1301 |
| 1239052 | N/A | N/A | 5795 | 5814 | TGTGCTTTTCCTTTCAGATT | 8 | 1302 |
| 1239074 | N/A | N/A | 5940 | 5959 | CCTTTCTCTTACAGAAAACT | 88 | 1303 |
| 1239096 | N/A | N/A | 6261 | 6280 | CTTTCAACCTTCCTAAGACC | 98 | 1304 |
| 1239118 | N/A | N/A | 6388 | 6407 | AAGCTGATTTTACAAGAAAT | 61 | 1305 |
| 1239140 | N/A | N/A | 6474 | 6493 | ATTTGATTACATTATTTTTA | 96 | 1306 |
| 1239162 | N/A | N/A | 6568 | 6587 | GTTCAGAGAATCTTTCACCT | 14 | 1307 |
| 1239184 | N/A | N/A | 6786 | 6805 | AATGGTTAACACATCGACAA | 49 | 1308 |
| 1239206 | N/A | N/A | 6917 | 6936 | CAGGCTTCAGTGCTAGGTCC | 85 | 1309 |
| 1239228 | N/A | N/A | 7340 | 7359 | GAGATCCAAATATAGGCACT | 19 | 1310 |
| 1239250 | N/A | N/A | 8038 | 8057 | TGGCACTTTCTTTTTATTTC | 12 | 1311 |
| 1239272 | N/A | N/A | 8235 | 8254 | TTCTATGGAATCTGTAGGTC | 14 | 1312 |
| 1239294 | N/A | N/A | 8519 | 8538 | GAGACAATAACCATACGATC | 38 | 1313 |
| 1239316 | N/A | N/A | 8884 | 8903 | CATGGAGCATGCTCCAAGAC | 86 | 1314 |
| 1239338 | N/A | N/A | 9113 | 9132 | GTCACCAGCAAATAATCTAC | 56 | 1315 |
| 1239360 | N/A | N/A | 9439 | 9458 | TTGTTCTATAAATTCATCTA | 58 | 1316 |
| 1239382 | N/A | N/A | 9755 | 9774 | AAGAAGAATACATTATGACC | 77 | 1317 |
| 1239404 | N/A | N/A | 10466 | 10485 | ACATCATAGAATGTTTTTTC | 49 | 1318 |
| 1239426 | N/A | N/A | 10743 | 10762 | ATTAGCTTAACACACATTTC | 56 | 1319 |
| 1239448 | N/A | N/A | 11336 | 11355 | GTTGTTGTTTCTTTTCTGGT | 5 | 1320 |
| 1239470 | N/A | N/A | 13314 | 13333 | GGTGACACATTATACAGAGA | 43 | 1321 |
| 1239492 | N/A | N/A | 13699 | 13718 | ATGGTCAATACCTGTTTATT | 53 | 1322 |
| 1239514 | N/A | N/A | 14090 | 14109 | AAACATTTATTTCATGTGCC | 51 | 1323 |
| 1239536 | N/A | N/A | 14240 | 14259 | ATGAATGGGAAAACACATGT | 118 | 1324 |
| 1239558 | N/A | N/A | 14397 | 14416 | CTACTTGAGATATTATGTTA | 80 | 1325 |
| 1239580 | N/A | N/A | 14841 | 14860 | AGCTTCTCAATTTTTCCAAC | 48 | 1326 |
| 1239602 | N/A | N/A | 15013 | 15032 | AGTCAGTAGCTTTCAGTCTA | 39 | 1327 |
| 1239624 | N/A | N/A | 15287 | 15306 | TCCTGTTTATGTTTCTACTA | 62 | 1328 |
| 1239646 | N/A | N/A | 15392 | 15411 | TGCAAATTTTTCTAAAAATT | 100 | 1329 |
| 1239668 | N/A | N/A | 15429 | 15448 | GAACTCAGAAACCCCTTACC | 58 | 1330 |
| 1239690 | N/A | N/A | 15528 | 15547 | ACCATATAATTCACCATATA | 48 | 1331 |
| 1239712 | N/A | N/A | 15708 | 15727 | CATAGGCTCCAAATCATCAC | 77 | 1332 |
| 1239734 | N/A | N/A | 15802 | 15821 | TCTCATTTACCCTGGGCACT | 53 | 1333 |
| 1239756 | N/A | N/A | 15842 | 15861 | GTACATTCATCAAATCAAAA | 51 | 1334 |

TABLE 18-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239778 | N/A | N/A | 15891 | 15910 | ACAAACAGATCAAACATCCA | 86 | 1335 |
| 1239800 | N/A | N/A | 15964 | 15983 | GATGAATGACTTTTAGTTCA | 65 | 1336 |

TABLE 19

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 10 | 66 |
| 1238129 | 61 | 80 | 3154 | 3173 | TGACTGTAAAAATCATCTTT | 89 | 1337 |
| 1238151 | 129 | 148 | 3222 | 3241 | AGATTCGCTTGAACACTTGC | 87 | 1338 |
| 1238173 | 585 | 604 | 16376 | 16395 | GCCCCCAGCCACCACCGCCC | 83 | 1339 |
| 1238195 | 605 | 624 | 16396 | 16415 | CCAGCCACCACCATGAGGCT | 82 | 1340 |
|  | 629 | 648 | 16420 | 16439 |  |  |  |
|  | 677 | 696 | 16468 | 16487 |  |  |  |
| 1238217 | 1037 | 1056 | 16828 | 16847 | CACGCGCTCCATCATCTTAA | 50 | 1341 |
| 1238239 | 1302 | 1321 | 17093 | 17112 | ATTGATTAGCCTATCCGGGA | 52 | 1342 |
| 1238261 | 1462 | 1481 | 17253 | 17272 | ACTAAGTCCAAAAATAAGTC | 72 | 1343 |
| 1238283 | 1617 | 1636 | 17408 | 17427 | GTTTTCTTAAAATGGAAAAT | 83 | 1344 |
| 1238305 | 1761 | 1780 | 17552 | 17571 | AGTAAAACATCACCCCAGTT | 42 | 1345 |
| 1238327 | 1818 | 1837 | 17609 | 17628 | GTGTTGTGACAATATTTACT | 6 | 1346 |
| 1238349 | 1864 | 1883 | 17655 | 17674 | GTTACAGTTATGTTCACTGT | 60 | 1347 |
| 1238371 | 1899 | 1918 | 17690 | 17709 | CATTTGATTTCAAGTCCCAG | 9 | 1348 |
| 1238393 | 1952 | 1971 | 17743 | 17762 | GGTCCTTTAAACATCTAAAA | 52 | 1349 |
| 1238415 | 2016 | 2035 | 17807 | 17826 | AAGGCAATTTACTTTTCAGC | 62 | 1350 |
| 1238437 | 2070 | 2089 | 17861 | 17880 | AATCATTCTGGTTTCCAGGT | 8 | 1351 |
| 1238459 | 2106 | 2125 | 17897 | 17916 | TGGTGCTTTCACAACTGCAG | 33 | 1352 |
| 1238481 | 2135 | 2154 | 17926 | 17945 | TTTTTTAATTACATCATCCT | 94 | 1353 |
| 1238503 | 2162 | 2181 | 17953 | 17972 | GCAGTTCTTTTCTTTGCACA | 46 | 1354 |
| 1238525 | 2218 | 2237 | 18009 | 18028 | GAACTTGACCTAATTCTGGT | 22 | 1355 |
| 1238547 | 2257 | 2276 | 18048 | 18067 | TCCCTATTCTTTGATTCAAA | 52 | 1356 |
| 1238569 | 2289 | 2308 | 18080 | 18099 | CATCTCCAACCTAAGATATT | 84 | 1357 |
| 1238591 | 2313 | 2332 | 18104 | 18123 | ACTTCAAATCAATCATATTT | 93 | 1358 |
| 1238613 | 2350 | 2369 | 18141 | 18160 | TTTTACTTTAATTAACATTA | 72 | 1359 |
| 1238635 | 2392 | 2411 | 18183 | 18202 | ACATATCTGCTAGGTGACAA | 21 | 1360 |
| 1238657 | 2480 | 2499 | 18271 | 18290 | CTATGCAATATATATTTTAT | 114 | 1361 |
| 1238679 | 2553 | 2572 | 18344 | 18363 | CAGTACCTTACAAAAGTTAA | 36 | 1362 |
| 1238701 | 2671 | 2690 | 18462 | 18481 | TACATGCATATTTCAAAGAC | 58 | 1363 |

TABLE 19-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238723 | 2749 | 2768 | 18540 | 18559 | GTCAGATATTAAACATTTAC | 56 | 1364 |
| 1238745 | N/A | N/A | 4787 | 4806 | GGGAAACACTTCAAATCATA | 51 | 1365 |
| 1238767 | N/A | N/A | 4836 | 4855 | TTGTAAAAATCCTTAATCCT | 70 | 1366 |
| 1238789 | N/A | N/A | 4883 | 4902 | TAACATATTTATCCAATTCC | 64 | 1367 |
| 1238811 | N/A | N/A | 4939 | 4958 | GTGATTTTTTCCTTTCTTCT | 22 | 1368 |
| 1238833 | N/A | N/A | 4999 | 5018 | CTTTTTTTCACTGTAAGACC | 40 | 1369 |
| 1238855 | N/A | N/A | 5053 | 5072 | ATAACATACAAATCACATCC | 83 | 1370 |
| 1238877 | N/A | N/A | 5109 | 5128 | ATCTATTATAATCTTAATAT | 100 | 1371 |
| 1238899 | N/A | N/A | 5151 | 5170 | ATTTGCATTTTATTGTGTAA | 66 | 1372 |
| 1238921 | N/A | N/A | 5216 | 5235 | TGCTGTTACTATTAATTATT | 72 | 1373 |
| 1238943 | N/A | N/A | 5389 | 5408 | AAAGTAGCTATCATTTCCTC | 61 | 1374 |
| 1238965 | N/A | N/A | 5471 | 5490 | TCTTAATGCATCACCAGATT | 53 | 1375 |
| 1238987 | N/A | N/A | 5599 | 5618 | TAGGCTCTTTTCCAGGTGTT | 9 | 1376 |
| 1239009 | N/A | N/A | 5667 | 5686 | GGTTACATAATGTTCATTTC | 4 | 1377 |
| 1239031 | N/A | N/A | 5720 | 5739 | TACTTGTCAGTTTTTCCCCA | 17 | 1378 |
| 1239053 | N/A | N/A | 5797 | 5816 | TCTGTGCTTTTCCTTTCAGA | 45 | 1379 |
| 1239075 | N/A | N/A | 5950 | 5969 | AACAATCTCTCCTTTCTCTT | 56 | 1380 |
| 1239097 | N/A | N/A | 6262 | 6281 | ACTTTCAACCTTCCTAAGAC | 94 | 1381 |
| 1239119 | N/A | N/A | 6389 | 6408 | TAAGCTGATTTTACAAGAAA | 70 | 1382 |
| 1239141 | N/A | N/A | 6477 | 6496 | GTTATTTGATTACATTATTT | 50 | 1383 |
| 1239163 | N/A | N/A | 6569 | 6588 | AGTTCAGAGAATCTTTCACC | 35 | 1384 |
| 1239185 | N/A | N/A | 6787 | 6806 | GAATGGTTAACACATCGACA | 27 | 1385 |
| 1239207 | N/A | N/A | 6924 | 6943 | CCGTGATCAGGCTTCAGTGC | 36 | 1386 |
| 1239229 | N/A | N/A | 7341 | 7360 | TGAGATCCAAATATAGGCAC | 59 | 1387 |
| 1239251 | N/A | N/A | 8040 | 8059 | AATGGCACTTTCTTTTTATT | 27 | 1388 |
| 1239273 | N/A | N/A | 8242 | 8261 | ATAGGGATTCTATGGAATCT | 57 | 1389 |
| 1239295 | N/A | N/A | 8526 | 8545 | ACAGAGTGAGACAATAACCA | 42 | 1390 |
| 1239317 | N/A | N/A | 8937 | 8956 | AATACAGGACATTCCATCCA | 78 | 1391 |
| 1239339 | N/A | N/A | 9211 | 9230 | GCAAGCTACAAAATTTTACT | 34 | 1392 |
| 1239361 | N/A | N/A | 9458 | 9477 | TTGCTTTTATGCTATTAGGT | 23 | 1393 |
| 1239383 | N/A | N/A | 9779 | 9798 | CAACTTATTTTAACAGTTTA | 77 | 1394 |
| 1239405 | N/A | N/A | 10474 | 10493 | GGACAGTAACATCATAGAAT | 20 | 1395 |
| 1239427 | N/A | N/A | 10744 | 10763 | GATTAGCTTAACACACATTT | 36 | 1396 |
| 1239449 | N/A | N/A | 11437 | 11456 | GGATTGTCTTTCTATTAAGA | 16 | 1397 |
| 1239471 | N/A | N/A | 13385 | 13404 | CAGATATTCAAAGTAACAAC | 50 | 1398 |
| 1239493 | N/A | N/A | 13701 | 13720 | TAATGGTCAATACCTGTTTA | 66 | 1399 |

TABLE 19-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239515 | N/A | N/A | 14112 | 14131 | AACATTTTCAATTCAGTTAA | 77 | 1400 |
| 1239537 | N/A | N/A | 14281 | 14300 | GCTTGACCCATAGACATGCA | 67 | 1401 |
| 1239559 | N/A | N/A | 14424 | 14443 | CTTCATTATTCTCTGGAGCA | 26 | 1402 |
| 1239581 | N/A | N/A | 14851 | 14870 | TAAGCACCTCAGCTTCTCAA | 92 | 1403 |
| 1239603 | N/A | N/A | 15014 | 15033 | CAGTCAGTAGCTTTCAGTCT | 32 | 1404 |
| 1239625 | N/A | N/A | 15288 | 15307 | ATCCTGTTTATGTTTCTACT | 36 | 1405 |
| 1239647 | N/A | N/A | 15393 | 15412 | CTGCAAATTTTTCTAAAAAT | 116 | 1406 |
| 1239669 | N/A | N/A | 15430 | 15449 | TGAACTCAGAAACCCCTTAC | 74 | 1407 |
| 1239691 | N/A | N/A | 15559 | 15578 | AATACCCAGCTTGTTGAGAT | 56 | 1408 |
| 1239713 | N/A | N/A | 15709 | 15728 | TCATAGGCTCCAAATCATCA | 61 | 1409 |
| 1239735 | N/A | N/A | 15803 | 15822 | ATCTCATTTACCCTGGGCAC | 60 | 1410 |
| 1239757 | N/A | N/A | 15843 | 15862 | TGTACATTCATCAAATCAAA | 82 | 1411 |
| 1239779 | N/A | N/A | 15892 | 15911 | AACAAACAGATCAAACATCC | 69 | 1412 |
| 1239801 | N/A | N/A | 16014 | 16033 | CAACTCTTTCTCCTGCTCCA | 45 | 1413 |

TABLE 20

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1201142 | 1963 | 1982 | 17754 | 17773 | GCCACATATAGGGTCCTTTA | 10 | 66 |
| 1238130 | 62 | 81 | 3155 | 3174 | TTGACTGTAAAAATCATCTT | 110 | 1414 |
| 1238152 | 131 | 150 | 3224 | 3243 | TGAGATTCGCTTGAACACTT | 101 | 1415 |
| 1238174 | 587 | 606 | 16378 | 16397 | CTGCCCCCAGCCACCACCGC | 64 | 1416 |
| 1238196 | 606 630 678 | 625 649 697 | 16397 16421 16469 | 16416 16440 16488 | CCCAGCCACCACCATGAGGC | 80 | 1417 |
| 1238218 | 1039 | 1058 | 16830 | 16849 | ACCACGCGCTCCATCATCTT | 54 | 1418 |
| 1238240 | 1326 | 1345 | 17117 | 17136 | CCAGTGCCCATCAGTGCCAA | 31 | 1419 |
| 1238262 | 1463 | 1482 | 17254 | 17273 | CACTAAGTCCAAAAATAAGT | 69 | 1420 |
| 1238284 | 1619 | 1638 | 17410 | 17429 | GGGTTTTCTTAAAATGGAAA | 18 | 1421 |
| 1238306 | 1763 | 1782 | 17554 | 17573 | AAAGTAAAACATCACCCCAG | 60 | 1422 |
| 1238328 | 1819 | 1838 | 17610 | 17629 | AGTGTTGTGACAATATTTAC | 17 | 1423 |
| 1238350 | 1865 | 1884 | 17656 | 17675 | TGTTACAGTTATGTTCACTG | 18 | 1424 |
| 1238372 | 1900 | 1919 | 17691 | 17710 | ACATTTGATTTCAAGTCCCA | 11 | 1425 |
| 1238394 | 1953 | 1972 | 17744 | 17763 | GGGTCCTTTAAACATCTAAA | 49 | 1426 |
| 1238416 | 2017 | 2036 | 17808 | 17827 | GAAGGCAATTTACTTTTCAG | 100 | 1427 |
| 1238438 | 2071 | 2090 | 17862 | 17881 | AAATCATTCTGGTTTCCAGG | 23 | 1428 |

TABLE 20-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1238460 | 2107 | 2126 | 17898 | 17917 | ATGGTGCTTTCACAACTGCA | 18 | 1429 |
| 1238482 | 2136 | 2155 | 17927 | 17946 | ATTTTTTAATTACATCATCC | 106 | 1430 |
| 1238504 | 2163 | 2182 | 17954 | 17973 | AGCAGTTCTTTTCTTTGCAC | 57 | 1431 |
| 1238526 | 2219 | 2238 | 18010 | 18029 | TGAACTTGACCTAATTCTGG | 48 | 1432 |
| 1238548 | 2258 | 2277 | 18049 | 18068 | CTCCCTATTCTTTGATTCAA | 57 | 1433 |
| 1238570 | 2291 | 2310 | 18082 | 18101 | GTCATCTCCAACCTAAGATA | 48 | 1434 |
| 1238592 | 2314 | 2333 | 18105 | 18124 | CACTTCAAATCAATCATATT | 99 | 1435 |
| 1238614 | 2351 | 2370 | 18142 | 18161 | ATTTTACTTTAATTAACATT | 117 | 1436 |
| 1238636 | 2393 | 2412 | 18184 | 18203 | TACATATCTGCTAGGTGACA | 20 | 1437 |
| 1238658 | 2482 | 2501 | 18273 | 18292 | TCCTATGCAATATATATTTT | 100 | 1438 |
| 1238680 | 2554 | 2573 | 18345 | 18364 | TCAGTACCTTACAAAAGTTA | 71 | 1439 |
| 1238702 | 2673 | 2692 | 18464 | 18483 | AGTACATGCATATTTCAAAG | 24 | 1440 |
| 1238724 | 2754 | 2773 | 18545 | 18564 | TTTCAGTCAGATATTAAACA | 95 | 1441 |
| 1238746 | N/A | N/A | 4788 | 4807 | CGGGAAACACTTCAAATCAT | 54 | 1442 |
| 1238768 | N/A | N/A | 4837 | 4856 | TTTGTAAAAATCCTTAATCC | 117 | 1443 |
| 1238790 | N/A | N/A | 4885 | 4904 | TTTAACATATTTATCCAATT | 124 | 1444 |
| 1238812 | N/A | N/A | 4940 | 4959 | GGTGATTTTTCCTTTCTTC | 8 | 1445 |
| 1238834 | N/A | N/A | 5002 | 5021 | TAGCTTTTTTTCACTGTAAG | 22 | 1446 |
| 1238856 | N/A | N/A | 5054 | 5073 | AATAACATACAAATCACATC | 108 | 1447 |
| 1238878 | N/A | N/A | 5112 | 5131 | TTTATCTATTATAATCTTAA | 92 | 1448 |
| 1238900 | N/A | N/A | 5152 | 5171 | AATTTGCATTTTATTGTGTA | 70 | 1449 |
| 1238922 | N/A | N/A | 5218 | 5237 | GTTGCTGTTACTATTAATTA | 79 | 1450 |
| 1238944 | N/A | N/A | 5390 | 5409 | GAAAGTAGCTATCATTTCCT | 73 | 1451 |
| 1238966 | N/A | N/A | 5472 | 5491 | TTCTTAATGCATCACCAGAT | 52 | 1452 |
| 1238988 | N/A | N/A | 5600 | 5619 | TTAGGCTCTTTTCCAGGTGT | 17 | 1453 |
| 1239010 | N/A | N/A | 5668 | 5687 | TGGTTACATAATGTTCATTT | 3 | 1454 |
| 1239032 | N/A | N/A | 5721 | 5740 | TTACTTGTCAGTTTTTCCCC | 34 | 1455 |
| 1239054 | N/A | N/A | 5801 | 5820 | ATTTTCTGTGCTTTTCCTTT | 33 | 1456 |
| 1239076 | N/A | N/A | 5951 | 5970 | TAACAATCTCTCCTTTCTCT | 68 | 1457 |
| 1239098 | N/A | N/A | 6263 | 6282 | GACTTTCAACCTTCCTAAGA | 62 | 1458 |
| 1239120 | N/A | N/A | 6390 | 6409 | TTAAGCTGATTTTACAAGAA | 89 | 1459 |
| 1239142 | N/A | N/A | 6478 | 6497 | TGTTATTTGATTACATTATT | 71 | 1460 |
| 1239164 | N/A | N/A | 6570 | 6589 | AAGTTCAGAGAATCTTTCAC | 79 | 1461 |
| 1239186 | N/A | N/A | 6788 | 6807 | GGAATGGTTAACACATCGAC | 58 | 1462 |
| 1239208 | N/A | N/A | 6952 | 6971 | CTATAAAAGCTTCTCAGGGA | 69 | 1463 |
| 1239230 | N/A | N/A | 7385 | 7404 | GTAAGAACTTATCCCAAGGT | 35 | 1464 |

TABLE 20-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RT542354 | SEQ ID NO |
|---|---|---|---|---|---|---|---|
| 1239252 | N/A | N/A | 8042 | 8061 | TAAATGGCACTTTCTTTTTA | 58 | 1465 |
| 1239274 | N/A | N/A | 8245 | 8264 | TTGATAGGGATTCTATGGAA | 59 | 1466 |
| 1239296 | N/A | N/A | 8544 | 8563 | GTGTGATACATCACAGTAAC | 77 | 1467 |
| 1239318 | N/A | N/A | 8938 | 8957 | AAATACAGGACATTCCATCC | 87 | 1468 |
| 1239340 | N/A | N/A | 9242 | 9261 | ATCTAGGATTTAACCTGAAA | 100 | 1469 |
| 1239362 | N/A | N/A | 9462 | 9481 | TCTATTGCTTTTATGCTATT | 65 | 1470 |
| 1239384 | N/A | N/A | 9780 | 9799 | CCAACTTATTTTAACAGTTT | 70 | 1471 |
| 1239406 | N/A | N/A | 10475 | 10494 | AGGACAGTAACATCATAGAA | 59 | 1472 |
| 1239428 | N/A | N/A | 10745 | 10764 | TGATTAGCTTAACACACATT | 88 | 1473 |
| 1239450 | N/A | N/A | 11438 | 11457 | TGGATTGTCTTTCTATTAAG | 36 | 1474 |
| 1239472 | N/A | N/A | 13386 | 13405 | ACAGATATTCAAAGTAACAA | 109 | 1475 |
| 1239494 | N/A | N/A | 13702 | 13721 | GTAATGGTCAATACCTGTTT | 55 | 1476 |
| 1239516 | N/A | N/A | 14113 | 14132 | TAACATTTTCAATTCAGTTA | 113 | 1477 |
| 1239538 | N/A | N/A | 14305 | 14324 | CACAGCAGTGTTCCTAGACA | 57 | 1478 |
| 1239560 | N/A | N/A | 14425 | 14444 | GCTTCATTATTCTCTGGAGC | 92 | 1479 |
| 1239582 | N/A | N/A | 14878 | 14897 | CAGTAGCTCTACCTTGAAAA | 72 | 1480 |
| 1239604 | N/A | N/A | 15043 | 15062 | CAGGAAATCAAACTAGGGCA | 65 | 1481 |
| 1239626 | N/A | N/A | 15289 | 15308 | CATCCTGTTTATGTTTCTAC | 58 | 1482 |
| 1239648 | N/A | N/A | 15394 | 15413 | GCTGCAAATTTTCTAAAAA | 84 | 1483 |
| 1239670 | N/A | N/A | 15431 | 15450 | GTGAACTCAGAAACCCCTTA | 39 | 1484 |
| 1239692 | N/A | N/A | 15620 | 15639 | TGATCTGCAATTGTTTTTCT | 49 | 1485 |
| 1239714 | N/A | N/A | 15710 | 15729 | ATCATAGGCTCCAAATCATC | 66 | 1486 |
| 1239736 | N/A | N/A | 15804 | 15823 | GATCTCATTTACCCTGGGCA | 94 | 1487 |
| 1239758 | N/A | N/A | 15844 | 15863 | ATGTACATTCATCAAATCAA | 67 | 1488 |
| 1239780 | N/A | N/A | 15893 | 15912 | CAACAAACAGATCAAACATC | 92 | 1489 |
| 1239802 | N/A | N/A | 16017 | 16036 | ACACAACTCTTTCTCCTGCT | 44 | 1490 |

TABLE 21

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 13 | 66 |
| 1238131 | 63 | 82 | 3156 | 3175 | ATTGACTGTAAAAATCATCT | 91 | 1491 |
| 1238153 | 132 | 151 | 3225 | 3244 | TTGAGATTCGCTTGAACACT | 117 | 1492 |
| 1238175 | 597 621 | 616 640 | 16388 16412 | 16407 16431 | CACCATGAGGCTGCCCCCAG | 72 | 1493 |

TABLE 21-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238197 | 683 | 702 | 16474 | 16493 | TTGACCCCAGCCACCACCAT | 64 | 1494 |
| 1238219 | 1048 | 1067 | 16839 | 16858 | ATCTGCTCAACCACGCGCTC | 84 | 1495 |
| 1238241 | 1327 | 1346 | 17118 | 17137 | TCCAGTGCCCATCAGTGCCA | 38 | 1496 |
| 1238263 | 1464 | 1483 | 17255 | 17274 | GCACTAAGTCCAAAAATAAG | 82 | 1497 |
| 1238285 | 1620 | 1639 | 17411 | 17430 | CGGGTTTTCTTAAAATGGAA | 13 | 1498 |
| 1238307 | 1764 | 1783 | 17555 | 17574 | AAAAGTAAAACATCACCCCA | 87 | 1499 |
| 1238329 | 1821 | 1840 | 17612 | 17631 | TCAGTGTTGTGACAATATTT | 9 | 1500 |
| 1238351 | 1866 | 1885 | 17657 | 17676 | ATGTTACAGTTATGTTCACT | 16 | 1501 |
| 1238373 | 1901 | 1920 | 17692 | 17711 | AACATTTGATTTCAAGTCCC | 8 | 1502 |
| 1238395 | 1955 | 1974 | 17746 | 17765 | TAGGGTCCTTTAAACATCTA | 68 | 1503 |
| 1238417 | 2019 | 2038 | 17810 | 17829 | TAGAAGGCAATTTACTTTTC | 72 | 1504 |
| 1238439 | 2074 | 2093 | 17865 | 17884 | TCAAAATCATTCTGGTTTCC | 50 | 1505 |
| 1238461 | 2108 | 2127 | 17899 | 17918 | GATGGTGCTTTCACAACTGC | 25 | 1506 |
| 1238483 | 2137 | 2156 | 17928 | 17947 | CATTTTTTAATTACATCATC | 118 | 1507 |
| 1238505 | 2164 | 2183 | 17955 | 17974 | AAGCAGTTCTTTTCTTTGCA | 35 | 1508 |
| 1238527 | 2220 | 2239 | 18011 | 18030 | ATGAACTTGACCTAATTCTG | 46 | 1509 |
| 1238549 | 2259 | 2278 | 18050 | 18069 | TCTCCCTATTCTTTGATTCA | 47 | 1510 |
| 1238571 | 2292 | 2311 | 18083 | 18102 | TGTCATCTCCAACCTAAGAT | 31 | 1511 |
| 1238593 | 2315 | 2334 | 18106 | 18125 | CCACTTCAAATCAATCATAT | 49 | 1512 |
| 1238615 | 2357 | 2376 | 18148 | 18167 | GGAATAATTTTACTTTAATT | 123 | 1513 |
| 1238637 | 2395 | 2414 | 18186 | 18205 | AATACATATCTGCTAGGTGA | 25 | 1514 |
| 1238659 | 2484 | 2503 | 18275 | 18294 | TGTCCTATGCAATATATATT | 69 | 1515 |
| 1238681 | 2555 | 2574 | 18346 | 18365 | TTCAGTACCTTACAAAAGTT | 89 | 1516 |
| 1238703 | 2676 | 2695 | 18467 | 18486 | TAAAGTACATGCATATTTCA | 74 | 1517 |
| 1238725 | 2780 | 2799 | 18571 | 18590 | GGTGGTGCTCATCTTCGCTC | 62 | 1518 |
| 1238747 | N/A | N/A | 4793 | 4812 | GGAAACGGGAAACACTTCAA | 69 | 1519 |
| 1238769 | N/A | N/A | 4840 | 4859 | ATATTTGTAAAAATCCTTAA | 108 | 1520 |
| 1238791 | N/A | N/A | 4886 | 4905 | GTTTAACATATTTATCCAAT | 25 | 1521 |
| 1238813 | N/A | N/A | 4941 | 4960 | TGGTGATTTTTCCTTTCTT | 16 | 1522 |
| 1238835 | N/A | N/A | 5003 | 5022 | TTAGCTTTTTTCACTGTAA | 11 | 1523 |
| 1238857 | N/A | N/A | 5059 | 5078 | ATATAAATAACATACAAATC | 105 | 1524 |
| 1238879 | N/A | N/A | 5113 | 5132 | ATTTATCTATTATAATCTTA | 104 | 1525 |
| 1238901 | N/A | N/A | 5154 | 5173 | CTAATTTGCATTTATTGTG | 48 | 1526 |
| 1238923 | N/A | N/A | 5244 | 5263 | AAGTTTTGGGCAACCTTCCA | 78 | 1527 |
| 1238945 | N/A | N/A | 5391 | 5410 | AGAAAGTAGCTATCATTTCC | 57 | 1528 |
| 1238967 | N/A | N/A | 5474 | 5493 | GCTTCTTAATGCATCACCAG | 30 | 1529 |
| 1238989 | N/A | N/A | 5601 | 5620 | TTTAGGCTCTTTTCCAGGTG | 18 | 1530 |

TABLE 21-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239011 | N/A | N/A | 5669 | 5688 | GTGGTTACATAATGTTCATT | 11 | 1531 |
| 1239033 | N/A | N/A | 5726 | 5745 | CTTTTTTACTTGTCAGTTTT | 48 | 1532 |
| 1239055 | N/A | N/A | 5825 | 5844 | CCGACAATTTCAATGAAAAC | 61 | 1533 |
| 1239077 | N/A | N/A | 5954 | 5973 | ATATAACAATCTCTCCTTTC | 72 | 1534 |
| 1239099 | N/A | N/A | 6264 | 6283 | TGACTTTCAACCTTCCTAAG | 80 | 1535 |
| 1239121 | N/A | N/A | 6407 | 6426 | GCCATTTCTCTGCAAAATTA | 41 | 1536 |
| 1239143 | N/A | N/A | 6479 | 6498 | TTGTTATTTGATTACATTAT | 66 | 1537 |
| 1239165 | N/A | N/A | 6586 | 6605 | AAGTAAGTTAAAACTGAAGT | 94 | 1538 |
| 1239187 | N/A | N/A | 6836 | 6855 | GATCACACAATACTGTAACA | 30 | 1539 |
| 1239209 | N/A | N/A | 6981 | 7000 | GAGAGTGCCTAGCGATGGGA | 98 | 1540 |
| 1239231 | N/A | N/A | 7388 | 7407 | CTAGTAAGAACTTATCCCAA | 36 | 1541 |
| 1239253 | N/A | N/A | 8043 | 8062 | GTAAATGGCACTTTCTTTTT | 22 | 1542 |
| 1239275 | N/A | N/A | 8302 | 8321 | CCTTCACCCAATTTTAGGAT | 66 | 1543 |
| 1239297 | N/A | N/A | 8545 | 8564 | AGTGTGATACATCACAGTAA | 92 | 1544 |
| 1239319 | N/A | N/A | 8947 | 8966 | CAAACAGACAAATACAGGAC | 77 | 1545 |
| 1239341 | N/A | N/A | 9277 | 9296 | AACATTCATTCATAATGGCA | 60 | 1546 |
| 1239363 | N/A | N/A | 9464 | 9483 | AATCTATTGCTTTTATGCTA | 81 | 1547 |
| 1239385 | N/A | N/A | 9781 | 9800 | CCCAACTTATTTTAACAGTT | 57 | 1548 |
| 1239407 | N/A | N/A | 10529 | 10548 | GAGAAATTTCTATTTTCCTC | 60 | 1549 |
| 1239429 | N/A | N/A | 10746 | 10765 | TTGATTAGCTTAACACACAT | 53 | 1550 |
| 1239451 | N/A | N/A | 11439 | 11458 | ATGGATTGTCTTTCTATTAA | 24 | 1551 |
| 1239473 | N/A | N/A | 13415 | 13434 | ACAGTAGCAATAACTGACCA | 86 | 1552 |
| 1239495 | N/A | N/A | 13718 | 13737 | TCCTATTAAGTATATGGTAA | 119 | 1553 |
| 1239517 | N/A | N/A | 14114 | 14133 | CTAACATTTTCAATTCAGTT | 45 | 1554 |
| 1239539 | N/A | N/A | 14318 | 14337 | GTTTGGTTTTGTTCACAGCA | 25 | 1555 |
| 1239561 | N/A | N/A | 14427 | 14446 | TGGCTTCATTATTCTCTGGA | 33 | 1556 |
| 1239583 | N/A | N/A | 14879 | 14898 | TCAGTAGCTCTACCTTGAAA | 83 | 1557 |
| 1239605 | N/A | N/A | 15103 | 15122 | GATGTAGTCCCCACAATCTC | 120 | 1558 |
| 1239627 | N/A | N/A | 15290 | 15309 | ACATCCTGTTTATGTTTCTA | 42 | 1559 |
| 1239649 | N/A | N/A | 15395 | 15414 | AGCTGCAAATTTTTCTAAAA | 99 | 1560 |
| 1239671 | N/A | N/A | 15432 | 15451 | TGTGAACTCAGAAACCCCTT | 60 | 1561 |
| 1239693 | N/A | N/A | 15622 | 15641 | GATGATCTGCAATTGTTTTT | 59 | 1562 |
| 1239715 | N/A | N/A | 15718 | 15737 | TAGGTCAAATCATAGGCTCC | 72 | 1563 |
| 1239737 | N/A | N/A | 15805 | 15824 | AGATCTCATTTACCCTGGGC | 80 | 1564 |
| 1239759 | N/A | N/A | 15845 | 15864 | AATGTACATTCATCAAATCA | 98 | 1565 |

TABLE 21-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239781 | N/A | N/A | 15899 | 15918 | CCAAAACAACAAACAGATCA | 90 | 1566 |
| 1239803 | N/A | N/A | 16018 | 16037 | AACACAACTCTTTCTCCTGC | 57 | 1567 |

TABLE 22

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1201142 | 1963 | 1982 | 17754 | 17773 | GCCACATATAGGGTCCTTTA | 11 | 66 |
| 1238132 | 65 | 84 | 3158 | 3177 | TCATTGACTGTAAAAATCAT | 93 | 1568 |
| 1238154 | 134 | 153 | 3227 | 3246 | AGTTGAGATTCGCTTGAACA | 107 | 1569 |
| 1238176 | 598 622 | 617 641 | 16389 16413 | 16408 16432 | CCACCATGAGGCTGCCCCCA | 64 | 1570 |
| 1238198 | 687 | 706 | 16478 | 16497 | CTCCTTGACCCCAGCCACCA | 64 | 1571 |
| 1238220 | 1055 | 1074 | 16846 | 16865 | GATACACATCTGCTCAACCA | 34 | 1572 |
| 1238242 | 1328 | 1347 | 17119 | 17138 | TTCCAGTGCCCATCAGTGCC | 41 | 1573 |
| 1238264 | 1469 | 1488 | 17260 | 17279 | CTGTTGCACTAAGTCCAAAA | 15 | 1574 |
| 1238286 | 1621 | 1640 | 17412 | 17431 | TCGGGTTTTCTTAAAATGGA | 17 | 1575 |
| 1238308 | 1765 | 1784 | 17556 | 17575 | GAAAAGTAAAACATCACCCC | 54 | 1576 |
| 1238330 | 1823 | 1842 | 17614 | 17633 | GTTCAGTGTTGTGACAATAT | 10 | 1577 |
| 1238352 | 1867 | 1886 | 17658 | 17677 | TATGTTACAGTTATGTTCAC | 45 | 1578 |
| 1238374 | 1902 | 1921 | 17693 | 17712 | AAACATTTGATTTCAAGTCC | 17 | 1579 |
| 1238396 | 1957 | 1976 | 17748 | 17767 | TATAGGGTCCTTTAAACATC | 23 | 1580 |
| 1238418 | 2020 | 2039 | 17811 | 17830 | CTAGAAGGCAATTTACTTTT | 86 | 1581 |
| 1238440 | 2075 | 2094 | 17866 | 17885 | GTCAAAATCATTCTGGTTTC | 8 | 1582 |
| 1238462 | 2109 | 2128 | 17900 | 17919 | TGATGGTGCTTTCACAACTG | 26 | 1583 |
| 1238484 | 2139 | 2158 | 17930 | 17949 | ACCATTTTTTAATTACATCA | 60 | 1584 |
| 1238506 | 2165 | 2184 | 17956 | 17975 | CAAGCAGTTCTTTTCTTTGC | 10 | 1585 |
| 1238528 | 2222 | 2241 | 18013 | 18032 | CTATGAACTTGACCTAATTC | 67 | 1586 |
| 1238550 | 2260 | 2279 | 18051 | 18070 | GTCTCCCTATTCTTTGATTC | 37 | 1587 |
| 1238572 | 2293 | 2312 | 18084 | 18103 | CTGTCATCTCCAACCTAAGA | 25 | 1588 |
| 1238594 | 2316 | 2335 | 18107 | 18126 | TCCACTTCAAATCAATCATA | 35 | 1589 |
| 1238616 | 2360 | 2379 | 18151 | 18170 | CAGGGAATAATTTTACTTTA | 27 | 1590 |
| 1238638 | 2397 | 2416 | 18188 | 18207 | GTAATACATATCTGCTAGGT | 19 | 1591 |
| 1238660 | 2486 | 2505 | 18277 | 18296 | TCTGTCCTATGCAATATATA | 62 | 1592 |
| 1238682 | 2556 | 2575 | 18347 | 18366 | ATTCAGTACCTTACAAAAGT | 54 | 1593 |
| 1238704 | 2699 | 2718 | 18490 | 18509 | CAAAGTTACAAATATAGAAA | 97 | 1594 |

TABLE 22-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1238726 | N/A | N/A | 3543 | 3562 | CCCGCGGCTCCCCTGCCCCC | 93 | 1595 |
| 1238748 | N/A | N/A | 4807 | 4826 | GGAGTTTTCCCTAAGGAAAC | 79 | 1596 |
| 1238770 | N/A | N/A | 4841 | 4860 | TATATTTGTAAAAATCCTTA | 93 | 1597 |
| 1238792 | N/A | N/A | 4887 | 4906 | AGTTTAACATATTTATCCAA | 69 | 1598 |
| 1238814 | N/A | N/A | 4942 | 4961 | CTGGTGATTTTTCCTTTCT | 10 | 1599 |
| 1238836 | N/A | N/A | 5004 | 5023 | GTTAGCTTTTTTTCACTGTA | 9 | 1600 |
| 1238858 | N/A | N/A | 5062 | 5081 | TAGATATAAATAACATACAA | 92 | 1601 |
| 1238880 | N/A | N/A | 5114 | 5133 | CATTTATCTATTATAATCTT | 86 | 1602 |
| 1238902 | N/A | N/A | 5155 | 5174 | TCTAATTTGCATTTTATTGT | 86 | 1603 |
| 1238924 | N/A | N/A | 5246 | 5265 | CCAAGTTTTGGGCAACCTTC | 43 | 1604 |
| 1238946 | N/A | N/A | 5392 | 5411 | CAGAAAGTAGCTATCATTTC | 57 | 1605 |
| 1238968 | N/A | N/A | 5476 | 5495 | CAGCTTCTTAATGCATCACC | 24 | 1606 |
| 1238990 | N/A | N/A | 5602 | 5621 | ATTTAGGCTCTTTTCCAGGT | 6 | 1607 |
| 1239012 | N/A | N/A | 5670 | 5689 | AGTGGTTACATAATGTTCAT | 26 | 1608 |
| 1239034 | N/A | N/A | 5727 | 5746 | ACTTTTTTACTTGTCAGTTT | 49 | 1609 |
| 1239056 | N/A | N/A | 5826 | 5845 | ACCGACAATTTCAATGAAAA | 42 | 1610 |
| 1239078 | N/A | N/A | 5958 | 5977 | GCAAATATAACAATCTCTCC | 55 | 1611 |
| 1239100 | N/A | N/A | 6266 | 6285 | GGTGACTTTCAACCTTCCTA | 52 | 1612 |
| 1239122 | N/A | N/A | 6411 | 6430 | TGTGGCCATTTCTCTGCAAA | 94 | 1613 |
| 1239144 | N/A | N/A | 6481 | 6500 | TATTGTTATTTGATTACATT | 97 | 1614 |
| 1239166 | N/A | N/A | 6670 | 6689 | TTTTGAATGTTTAATATGCA | 91 | 1615 |
| 1239188 | N/A | N/A | 6838 | 6857 | GTGATCACACAATACTGTAA | 76 | 1616 |
| 1239210 | N/A | N/A | 7011 | 7030 | ACATTGCTGGAACCCATCAC | 86 | 1617 |
| 1239232 | N/A | N/A | 7389 | 7408 | GCTAGTAAGAACTTATCCCA | 43 | 1618 |
| 1239254 | N/A | N/A | 8044 | 8063 | TGTAAATGGCACTTTCTTTT | 26 | 1619 |
| 1239276 | N/A | N/A | 8303 | 8322 | ACCTTCACCCAATTTTAGGA | 61 | 1620 |
| 1239298 | N/A | N/A | 8546 | 8565 | AAGTGTGATACATCACAGTA | 91 | 1621 |
| 1239320 | N/A | N/A | 8948 | 8967 | CCAAACAGACAAATACAGGA | 68 | 1622 |
| 1239342 | N/A | N/A | 9304 | 9323 | GCTGTAGTTAAACATTTCAT | 21 | 1623 |
| 1239364 | N/A | N/A | 9472 | 9491 | TGAACAATAATCTATTGCTT | 57 | 1624 |
| 1239386 | N/A | N/A | 9782 | 9801 | ACCCAACTTATTTAACAGT | 64 | 1625 |
| 1239408 | N/A | N/A | 10531 | 10550 | GAGAGAAATTTCTATTTTCC | 56 | 1626 |
| 1239430 | N/A | N/A | 10747 | 10766 | ATTGATTAGCTTAACACACA | 48 | 1627 |
| 1239452 | N/A | N/A | 11475 | 11494 | ATGCAACTTTCCTTAATGAA | 23 | 1628 |
| 1239474 | N/A | N/A | 13417 | 13436 | CTACAGTAGCAATAACTGAC | 91 | 1629 |
| 1239496 | N/A | N/A | 13726 | 13745 | TCAAGATATCCTATTAAGTA | 83 | 1630 |
| 1239518 | N/A | N/A | 14115 | 14134 | GCTAACATTTTCAATTCAGT | 23 | 1631 |

TABLE 22-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS42354 | SEQ ID NO |
|---|---|---|---|---|---|---|---|
| 1239540 | N/A | N/A | 14321 | 14340 | GGAGTTTGGTTTTGTTCACA | 21 | 1632 |
| 1239562 | N/A | N/A | 14472 | 14491 | CCATCACTCTACCTAAAACA | 97 | 1633 |
| 1239584 | N/A | N/A | 14892 | 14911 | CTATCAGCAAATCTCAGTAG | 59 | 1634 |
| 1239606 | N/A | N/A | 15161 | 15180 | TTGGAGGCTCTTTTAGGTGG | 40 | 1635 |
| 1239628 | N/A | N/A | 15293 | 15312 | TTAACATCCTGTTTATGTTT | 94 | 1636 |
| 1239650 | N/A | N/A | 15396 | 15415 | TAGCTGCAAATTTTTCTAAA | 74 | 1637 |
| 1239672 | N/A | N/A | 15433 | 15452 | TTGTGAACTCAGAAACCCCT | 60 | 1638 |
| 1239694 | N/A | N/A | 15624 | 15643 | GGGATGATCTGCAATTGTTT | 29 | 1639 |
| 1239716 | N/A | N/A | 15719 | 15738 | CTAGGTCAAATCATAGGCTC | 75 | 1640 |
| 1239738 | N/A | N/A | 15808 | 15827 | TAAAGATCTCATTTACCCTG | 85 | 1641 |
| 1239760 | N/A | N/A | 15846 | 15865 | GAATGTACATTCATCAAATC | 92 | 1642 |
| 1239782 | N/A | N/A | 15900 | 15919 | ACCAAAACAACAAACAGATC | 93 | 1643 |
| 1239804 | N/A | N/A | 16020 | 16039 | TGAACACAACTCTTTCTCCT | 71 | 1644 |

TABLE 23

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1201142 | 1963 | 1982 | 17754 | 17773 | GCCACATATAGGGTCCTTTA | 11 | 66 |
| 1238133 | 66 | 85 | 3159 | 3178 | CTCATTGACTGTAAAAATCA | 131 | 1645 |
| 1238155 | 135 | 154 | 3228 | 3247 | GAGTTGAGATTCGCTTGAAC | 102 | 1646 |
| 1238177 | 599<br>623 | 618<br>642 | 16390<br>16414 | 16409<br>16433 | ACCACCATGAGGCTGCCCCC | 69 | 1647 |
| 1238199 | 695 | 714 | 16486 | 16505 | GGTGCCACCTCCTTGACCCC | 90 | 1648 |
| 1238221 | 1060 | 1079 | 16851 | 16870 | TGGGTGATACACATCTGCTC | 65 | 1649 |
| 1238243 | 1329 | 1348 | 17120 | 17139 | TTTCCAGTGCCCATCAGTGC | 30 | 1650 |
| 1238265 | 1479 | 1498 | 17270 | 17289 | TAGCCTCAACCTGTTGCACT | 49 | 1651 |
| 1238287 | 1650 | 1669 | 17441 | 17460 | GCCTCCTAACAAACCTGGCA | 100 | 1652 |
| 1238309 | 1766 | 1785 | 17557 | 17576 | TGAAAAGTAAAACATCACCC | 41 | 1653 |
| 1238331 | 1824 | 1843 | 17615 | 17634 | GGTTCAGTGTTGTGACAATA | 9 | 1654 |
| 1238353 | 1868 | 1887 | 17659 | 17678 | ATATGTTACAGTTATGTTCA | 21 | 1655 |
| 1238375 | 1903 | 1922 | 17694 | 17713 | CAAACATTTGATTTCAAGTC | 69 | 1656 |
| 1238397 | 1958 | 1977 | 17749 | 17768 | ATATAGGGTCCTTTAAACAT | 42 | 1657 |
| 1238419 | 2021 | 2040 | 17812 | 17831 | TCTAGAAGGCAATTTACTTT | 123 | 1658 |
| 1238441 | 2076 | 2095 | 17867 | 17886 | TGTCAAAATCATTCTGGTTT | 18 | 1659 |

TABLE 23-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1238463 | 2110 | 2129 | 17901 | 17920 | ATGATGGTGCTTTCACAACT | 29 | 1660 |
| 1238485 | 2140 | 2159 | 17931 | 17950 | GACCATTTTTAATTACATC | 49 | 1661 |
| 1238507 | 2166 | 2185 | 17957 | 17976 | GCAAGCAGTTCTTTTCTTTG | 7 | 1662 |
| 1238529 | 2226 | 2245 | 18017 | 18036 | GAAACTATGAACTTGACCTA | 51 | 1663 |
| 1238551 | 2261 | 2280 | 18052 | 18071 | TGTCTCCCTATTCTTTGATT | 32 | 1664 |
| 1238573 | 2294 | 2313 | 18085 | 18104 | TCTGTCATCTCCAACCTAAG | 27 | 1665 |
| 1238595 | 2317 | 2336 | 18108 | 18127 | TTCCACTTCAAATCAATCAT | 37 | 1666 |
| 1238617 | 2361 | 2380 | 18152 | 18171 | TCAGGGAATAATTTTACTTT | 29 | 1667 |
| 1238639 | 2398 | 2417 | 18189 | 18208 | AGTAATACATATCTGCTAGG | 31 | 1668 |
| 1238661 | 2487 | 2506 | 18278 | 18297 | GTCTGTCCTATGCAATATAT | 53 | 1669 |
| 1238683 | 2557 | 2576 | 18348 | 18367 | TATTCAGTACCTTACAAAAG | 82 | 1670 |
| 1238705 | 2700 | 2719 | 18491 | 18510 | GCAAAGTTACAAATATAGAA | 59 | 1671 |
| 1238749 | N/A | N/A | 4808 | 4827 | AGGAGTTTTCCCTAAGGAAA | 60 | 1672 |
| 1238771 | N/A | N/A | 4842 | 4861 | TTATATTTGTAAAAATCCTT | 94 | 1673 |
| 1238793 | N/A | N/A | 4888 | 4907 | AAGTTTAACATATTTATCCA | 87 | 1674 |
| 1238815 | N/A | N/A | 4943 | 4962 | ACTGGTGATTTTTTCCTTTC | 33 | 1675 |
| 1238837 | N/A | N/A | 5005 | 5024 | GGTTAGCTTTTTTTCACTGT | 8 | 1676 |
| 1238859 | N/A | N/A | 5063 | 5082 | TTAGATATAAATAACATACA | 108 | 1677 |
| 1238881 | N/A | N/A | 5115 | 5134 | CCATTTATCTATTATAATCT | 48 | 1678 |
| 1238903 | N/A | N/A | 5157 | 5176 | GCTCTAATTTGCATTTTATT | 27 | 1679 |
| 1238925 | N/A | N/A | 5262 | 5281 | CAGACACTTGAAAATGCCAA | 68 | 1680 |
| 1238947 | N/A | N/A | 5393 | 5412 | GCAGAAAGTAGCTATCATTT | 11 | 1681 |
| 1238969 | N/A | N/A | 5477 | 5496 | CCAGCTTCTTAATGCATCAC | 29 | 1682 |
| 1238991 | N/A | N/A | 5611 | 5630 | GTGTTATACATTTAGGCTCT | 11 | 1683 |
| 1239013 | N/A | N/A | 5672 | 5691 | TTAGTGGTTACATAATGTTC | 31 | 1684 |
| 1239035 | N/A | N/A | 5730 | 5749 | CCCACTTTTTTACTTGTCAG | 36 | 1685 |
| 1239057 | N/A | N/A | 5828 | 5847 | TCACCGACAATTTCAATGAA | 77 | 1686 |
| 1239079 | N/A | N/A | 5959 | 5978 | AGCAAATATAACAATCTCTC | 27 | 1687 |
| 1239101 | N/A | N/A | 6267 | 6286 | TGGTGACTTTCAACCTTCCT | 98 | 1688 |
| 1239123 | N/A | N/A | 6413 | 6432 | TCTGTGGCCATTTCTCTGCA | 46 | 1689 |
| 1239145 | N/A | N/A | 6486 | 6505 | GTTATTATTGTTATTTGATT | 54 | 1690 |
| 1239167 | N/A | N/A | 6674 | 6693 | CATGTTTTGAATGTTTAATA | 93 | 1691 |
| 1239189 | N/A | N/A | 6845 | 6864 | CCTTAAAGTGATCACACAAT | 89 | 1692 |
| 1239211 | N/A | N/A | 7142 | 7161 | CTGAAAAAAATTTTGCACAA | 90 | 1693 |
| 1239233 | N/A | N/A | 7431 | 7450 | GTTCATCTTATTCCCATTTA | 31 | 1694 |
| 1239255 | N/A | N/A | 8080 | 8099 | GCTAAATTTATTCTGAAATA | 94 | 1695 |

TABLE 23-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1239277 | N/A | N/A | 8311 | 8330 | AAGATGCCACCTTCACCCAA | 74 | 1696 |
| 1239299 | N/A | N/A | 8603 | 8622 | TGATACAGTGGGATTCATCC | 108 | 1697 |
| 1239321 | N/A | N/A | 8965 | 8984 | ACTTAGACCAAATGGATCCA | 85 | 1698 |
| 1239343 | N/A | N/A | 9349 | 9368 | AGTTTTTCAAATCAACAAAT | 71 | 1699 |
| 1239365 | N/A | N/A | 9519 | 9538 | CCCAAGATATCATAATTTTA | 59 | 1700 |
| 1239387 | N/A | N/A | 9785 | 9804 | AGCACCCAACTTATTTTAAC | 69 | 1701 |
| 1239409 | N/A | N/A | 10629 | 10648 | GGAGATCAAATCTGTGGAGC | 47 | 1702 |
| 1239431 | N/A | N/A | 10759 | 10778 | GCACAATAATTTATTGATTA | 105 | 1703 |
| 1239453 | N/A | N/A | 12112 | 12131 | GTAAAGATTCTTGTTCAGCA | 23 | 1704 |
| 1239475 | N/A | N/A | 13429 | 13448 | AACGGCATTCCTCTACAGTA | 86 | 1705 |
| 1239497 | N/A | N/A | 13727 | 13746 | TTCAAGATATCCTATTAAGT | 90 | 1706 |
| 1239519 | N/A | N/A | 14117 | 14136 | CAGCTAACATTTTCAATTCA | 65 | 1707 |
| 1239541 | N/A | N/A | 14342 | 14361 | AGTGCAGGCTCCTTTAGGGC | 33 | 1708 |
| 1239563 | N/A | N/A | 14526 | 14545 | AAGGCTTTTCTTCCAGCTAC | 76 | 1709 |
| 1239585 | N/A | N/A | 14893 | 14912 | TCTATCAGCAAATCTCAGTA | 90 | 1710 |
| 1239607 | N/A | N/A | 15162 | 15181 | TTTGGAGGCTCTTTTAGGTG | 19 | 1711 |
| 1239629 | N/A | N/A | 15299 | 15318 | AATAAATTAACATCCTGTTT | 83 | 1712 |
| 1239651 | N/A | N/A | 15397 | 15416 | TTAGCTGCAAATTTTTCTAA | 72 | 1713 |
| 1239673 | N/A | N/A | 15443 | 15462 | TAGAACATTTTGTGAACTC | 30 | 1714 |
| 1239695 | N/A | N/A | 15625 | 15644 | TGGGATGATCTGCAATTGTT | 34 | 1715 |
| 1239717 | N/A | N/A | 15720 | 15739 | CCTAGGTCAAATCATAGGCT | 80 | 1716 |
| 1239739 | N/A | N/A | 15809 | 15828 | TTAAAGATCTCATTTACCCT | 118 | 1717 |
| 1239761 | N/A | N/A | 15847 | 15866 | AGAATGTACATTCATCAAAT | 74 | 1718 |
| 1239783 | N/A | N/A | 15901 | 15920 | TACCAAAACAACAAACAGAT | 77 | 1719 |
| 1239805 | N/A | N/A | 16021 | 16040 | GTGAACACAACTCTTTCTCC | 64 | 1720 |

TABLE 24

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1201142 | 1963 | 1982 | 17754 | 17773 | GCCACATATAGGGTCCTTTA | 12 | 66 |
| 1238134 | 67 | 86 | 3160 | 3179 | GCTCATTGACTGTAAAAATC | 96 | 1721 |
| 1238156 | 139 | 158 | 3232 | 3251 | AAACGAGTTGAGATTCGCTT | 101 | 1722 |
| 1238178 | 600 624 | 619 643 | 16391 16415 | 16410 16434 | CACCACCATGAGGCTGCCCC | 75 | 1723 |
| 1238200 | 697 | 716 | 16488 | 16507 | TGGGTGCCACCTCCTTGACC | 97 | 1724 |

TABLE 24-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1238222 | 1179 | 1198 | 16970 | 16989 | ACCTTCCTCATCCCACTATC | 105 | 1725 |
| 1238244 | 1336 | 1355 | 17127 | 17146 | TCTATGTTTTCCAGTGCCCA | 15 | 1726 |
| 1238266 | 1482 | 1501 | 17273 | 17292 | TTTTAGCCTCAACCTGTTGC | 48 | 1727 |
| 1238288 | 1655 | 1674 | 17446 | 17465 | ATGTGGCCTCCTAACAAACC | 86 | 1728 |
| 1238310 | 1767 | 1786 | 17558 | 17577 | GTGAAAAGTAAAACATCACC | 66 | 1729 |
| 1238332 | 1825 | 1844 | 17616 | 17635 | AGGTTCAGTGTTGTGACAAT | 31 | 1730 |
| 1238354 | 1869 | 1888 | 17660 | 17679 | TATATGTTACAGTTATGTTC | 40 | 1731 |
| 1238376 | 1904 | 1923 | 17695 | 17714 | CCAAACATTTGATTTCAAGT | 75 | 1732 |
| 1238398 | 1969 | 1988 | 17760 | 17779 | AGGAATGCCACATATAGGGT | 37 | 1733 |
| 1238420 | 2022 | 2041 | 17813 | 17832 | GTCTAGAAGGCAATTTACTT | 72 | 1734 |
| 1238442 | 2077 | 2096 | 17868 | 17887 | ATGTCAAAATCATTCTGGTT | 29 | 1735 |
| 1238464 | 2111 | 2130 | 17902 | 17921 | GATGATGGTGCTTTCACAAC | 33 | 1736 |
| 1238486 | 2141 | 2160 | 17932 | 17951 | TGACCATTTTTAATTACAT | 83 | 1737 |
| 1238508 | 2167 | 2186 | 17958 | 17977 | TGCAAGCAGTTCTTTTCTTT | 15 | 1738 |
| 1238530 | 2227 | 2246 | 18018 | 18037 | AGAAACTATGAACTTGACCT | 29 | 1739 |
| 1238552 | 2262 | 2281 | 18053 | 18072 | TTGTCTCCCTATTCTTTGAT | 38 | 1740 |
| 1238574 | 2295 | 2314 | 18086 | 18105 | TTCTGTCATCTCCAACCTAA | 41 | 1741 |
| 1238596 | 2318 | 2337 | 18109 | 18128 | TTTCCACTTCAAATCAATCA | 49 | 1742 |
| 1238618 | 2362 | 2381 | 18153 | 18172 | TTCAGGGAATAATTTTACTT | 48 | 1743 |
| 1238640 | 2399 | 2418 | 18190 | 18209 | AAGTAATACATATCTGCTAG | 47 | 1744 |
| 1238662 | 2503 | 2522 | 18294 | 18313 | TAAACAAAACTCCTAAGTCT | 111 | 1745 |
| 1238684 | 2558 | 2577 | 18349 | 18368 | GTATTCAGTACCTTACAAAA | 43 | 1746 |
| 1238706 | 2701 | 2720 | 18492 | 18511 | TGCAAAGTTACAAATATAGA | 85 | 1747 |
| 1238728 | N/A | N/A | 4709 | 4728 | AGATCCTCATCATTACAGCA | 87 | 1748 |
| 1238750 | N/A | N/A | 4809 | 4828 | CAGGAGTTTTCCCTAAGGAA | 48 | 1749 |
| 1238772 | N/A | N/A | 4848 | 4867 | TGATAATTATATTTGTAAAA | 108 | 1750 |
| 1238794 | N/A | N/A | 4889 | 4908 | GAAGTTTAACATATTTATCC | 38 | 1751 |
| 1238816 | N/A | N/A | 4945 | 4964 | CCACTGGTGATTTTTTCCTT | 36 | 1752 |
| 1238838 | N/A | N/A | 5006 | 5025 | TGGTTAGCTTTTTTTCACTG | 12 | 1753 |
| 1238860 | N/A | N/A | 5064 | 5083 | GTTAGATATAAATAACATAC | 48 | 1754 |
| 1238882 | N/A | N/A | 5116 | 5135 | GCCATTTATCTATTATAATC | 32 | 1755 |
| 1238904 | N/A | N/A | 5159 | 5178 | ATGCTCTAATTTGCATTTTA | 59 | 1756 |
| 1238926 | N/A | N/A | 5263 | 5282 | CCAGACACTTGAAAATGCCA | 75 | 1757 |
| 1238948 | N/A | N/A | 5394 | 5413 | CGCAGAAAGTAGCTATCATT | 33 | 1758 |
| 1238970 | N/A | N/A | 5480 | 5499 | CTTCCAGCTTCTTAATGCAT | 64 | 1759 |
| 1238992 | N/A | N/A | 5613 | 5632 | TGGTGTTATACATTTAGGCT | 20 | 1760 |

TABLE 24-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1239014 | N/A | N/A | 5680 | 5699 | CATGATTTTAGTGGTTACA | 11 | 1761 |
| 1239036 | N/A | N/A | 5732 | 5751 | AACCCACTTTTTACTTGTC | 55 | 1762 |
| 1239058 | N/A | N/A | 5829 | 5848 | ATCACCGACAATTTCAATGA | 77 | 1763 |
| 1239080 | N/A | N/A | 5960 | 5979 | TAGCAAATATAACAATCTCT | 48 | 1764 |
| 1239102 | N/A | N/A | 6268 | 6287 | TTGGTGACTTTCAACCTTCC | 93 | 1765 |
| 1239124 | N/A | N/A | 6416 | 6435 | AAATCTGTGGCCATTTCTCT | 61 | 1766 |
| 1239146 | N/A | N/A | 6493 | 6512 | CTGTTATGTTATTATTGTTA | 19 | 1767 |
| 1239168 | N/A | N/A | 6675 | 6694 | ACATGTTTTGAATGTTTAAT | 76 | 1768 |
| 1239190 | N/A | N/A | 6848 | 6867 | CTCCCTTAAAGTGATCACAC | 92 | 1769 |
| 1239212 | N/A | N/A | 7143 | 7162 | GCTGAAAAAATTTTGCACA | 86 | 1770 |
| 1239234 | N/A | N/A | 7432 | 7451 | CGTTCATCTTATTCCCATTT | 17 | 1771 |
| 1239256 | N/A | N/A | 8082 | 8101 | TGGCTAAATTTATTCTGAAA | 68 | 1772 |
| 1239278 | N/A | N/A | 8312 | 8331 | AAAGATGCCACCTTCACCCA | 89 | 1773 |
| 1239300 | N/A | N/A | 8616 | 8635 | AGATCATTTACTATGATACA | 109 | 1774 |
| 1239322 | N/A | N/A | 8975 | 8994 | CTTACACTTCACTTAGACCA | 70 | 1775 |
| 1239344 | N/A | N/A | 9351 | 9370 | GTAGTTTTTCAAATCAACAA | 54 | 1776 |
| 1239366 | N/A | N/A | 9520 | 9539 | GCCCAAGATATCATAATTTT | 74 | 1777 |
| 1239388 | N/A | N/A | 9786 | 9805 | CAGCACCCAACTTATTTTAA | 72 | 1778 |
| 1239410 | N/A | N/A | 10631 | 10650 | AAGGAGATCAAATCTGTGGA | 52 | 1779 |
| 1239432 | N/A | N/A | 10760 | 10779 | GGCACAATAATTTATTGATT | 92 | 1780 |
| 1239454 | N/A | N/A | 12311 | 12330 | TGCAGAGGAACAACACATAC | 109 | 1781 |
| 1239476 | N/A | N/A | 13492 | 13511 | GATAACATGAGAACCAACGC | 98 | 1782 |
| 1239498 | N/A | N/A | 13728 | 13747 | TTTCAAGATATCCTATTAAG | 85 | 1783 |
| 1239520 | N/A | N/A | 14118 | 14137 | CCAGCTAACATTTTCAATTC | 51 | 1784 |
| 1239542 | N/A | N/A | 14365 | 14384 | TTATTATTCATGTTCTCCAC | 79 | 1785 |
| 1239564 | N/A | N/A | 14529 | 14548 | TAGAAGGCTTTTCTTCCAGC | 60 | 1786 |
| 1239586 | N/A | N/A | 14901 | 14920 | ACATTGGATCTATCAGCAAA | 77 | 1787 |
| 1239608 | N/A | N/A | 15195 | 15214 | AGTTAAAGTACTCAGGTCAT | 66 | 1788 |
| 1239630 | N/A | N/A | 15300 | 15319 | AAATAAATTAACATCCTGTT | 97 | 1789 |
| 1239652 | N/A | N/A | 15399 | 15418 | AATTAGCTGCAAATTTTTCT | 78 | 1790 |
| 1239674 | N/A | N/A | 15445 | 15464 | TTTAGAACATTTTTGTGAAC | 82 | 1791 |
| 1239696 | N/A | N/A | 15648 | 15667 | GAAGTTAGTCTTGTCCTCAG | 31 | 1792 |
| 1239718 | N/A | N/A | 15721 | 15740 | CCCTAGGTCAAATCATAGGC | 99 | 1793 |
| 1239740 | N/A | N/A | 15810 | 15829 | ATTAAAGATCTCATTTACCC | 85 | 1794 |
| 1239762 | N/A | N/A | 15848 | 15867 | GAGAATGTACATTCATCAAA | 65 | 1795 |

TABLE 24-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1239784 | N/A | N/A | 15903 | 15922 | TGTACCAAAACAACAAACAG | 102 | 1796 |
| 1239806 | N/A | N/A | 16082 | 16101 | ACACTGTTGCCACCCTGTAC | 85 | 1797 |

TABLE 25

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1201142 | 1963 | 1982 | 17754 | 17773 | GCCACATATAGGGTCCTTTA | 12 | 66 |
| 1238135 | 68 | 87 | 3161 | 3180 | GGCTCATTGACTGTAAAAAT | 120 | 1798 |
| 1238157 | 140 | 159 | 3233 | 3252 | AAAACGAGTTGAGATTCGCT | 132 | 1799 |
| 1238179 | 601 625 | 620 644 | 16392 16416 | 16411 16435 | CCACCACCATGAGGCTGCCC | 84 | 1800 |
| 1238201 | 701 | 720 | 16492 | 16511 | ACTGTGGGTGCCACCTCCTT | 73 | 1801 |
| 1238223 | 1181 | 1200 | 16972 | 16991 | AGACCTTCCTCATCCCACTA | 107 | 1802 |
| 1238245 | 1341 | 1360 | 17132 | 17151 | TCTACTCTATGTTTTCCAGT | 27 | 1803 |
| 1238267 | 1485 | 1504 | 17276 | 17295 | TTGTTTTAGCCTCAACCTGT | 48 | 1804 |
| 1238289 | 1656 | 1675 | 17447 | 17466 | CATGTGGCCTCCTAACAAAC | 81 | 1805 |
| 1238311 | 1768 | 1787 | 17559 | 17578 | TGTGAAAAGTAAAACATCAC | 84 | 1806 |
| 1238333 | 1826 | 1845 | 17617 | 17636 | GAGGTTCAGTGTTGTGACAA | 34 | 1807 |
| 1238355 | 1870 | 1889 | 17661 | 17680 | ATATATGTTACAGTTATGTT | 82 | 1808 |
| 1238377 | 1906 | 1925 | 17697 | 17716 | TCCCAAACATTTGATTTCAA | 83 | 1809 |
| 1238399 | 1981 | 2000 | 17772 | 17791 | TAGTTTAAAGAAAGGAATGC | 129 | 1810 |
| 1238421 | 2023 | 2042 | 17814 | 17833 | TGTCTAGAAGGCAATTTACT | 120 | 1811 |
| 1238443 | 2078 | 2097 | 17869 | 17888 | TATGTCAAAATCATTCTGGT | 22 | 1812 |
| 1238465 | 2112 | 2131 | 17903 | 17922 | TGATGATGGTGCTTTCACAA | 25 | 1813 |
| 1238487 | 2142 | 2161 | 17933 | 17952 | CTGACCATTTTTAATTACA | 36 | 1814 |
| 1238509 | 2168 | 2187 | 17959 | 17978 | ATGCAAGCAGTTCTTTTCTT | 22 | 1815 |
| 1238531 | 2228 | 2247 | 18019 | 18038 | CAGAAACTATGAACTTGACC | 34 | 1816 |
| 1238553 | 2263 | 2282 | 18054 | 18073 | ATTGTCTCCCTATTCTTTGA | 44 | 1817 |
| 1238575 | 2296 | 2315 | 18087 | 18106 | TTTCTGTCATCTCCAACCTA | 61 | 1818 |
| 1238597 | 2319 | 2338 | 18110 | 18129 | TTTTCCACTTCAAATCAATC | 61 | 1819 |
| 1238619 | 2363 | 2382 | 18154 | 18173 | ATTCAGGGAATAATTTTACT | 75 | 1820 |
| 1238641 | 2401 | 2420 | 18192 | 18211 | AAAAGTAATACATATCTGCT | 72 | 1821 |
| 1238663 | 2507 | 2526 | 18298 | 18317 | GCTCTAAACAAAACTCCTAA | 61 | 1822 |
| 1238685 | 2559 | 2578 | 18350 | 18369 | AGTATTCAGTACCTTACAAA | 48 | 1823 |
| 1238707 | 2704 | 2723 | 18495 | 18514 | ACATGCAAAGTTACAAATAT | 82 | 1824 |

TABLE 25-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1238729 | N/A | N/A | 4712 | 4731 | TGAAGATCCTCATCATTACA | 102 | 1825 |
| 1238751 | N/A | N/A | 4810 | 4829 | CCAGGAGTTTTCCCTAAGGA | 66 | 1826 |
| 1238773 | N/A | N/A | 4849 | 4868 | TTGATAATTATATTTGTAAA | 114 | 1827 |
| 1238795 | N/A | N/A | 4890 | 4909 | AGAAGTTTAACATATTTATC | 103 | 1828 |
| 1238817 | N/A | N/A | 4946 | 4965 | TCCACTGGTGATTTTTCCT | 50 | 1829 |
| 1238839 | N/A | N/A | 5007 | 5026 | CTGGTTAGCTTTTTTTCACT | 17 | 1830 |
| 1238861 | N/A | N/A | 5065 | 5084 | TGTTAGATATAAATAACATA | 100 | 1831 |
| 1238883 | N/A | N/A | 5117 | 5136 | TGCCATTTATCTATTATAAT | 88 | 1832 |
| 1238905 | N/A | N/A | 5162 | 5181 | AACATGCTCTAATTTGCATT | 107 | 1833 |
| 1238927 | N/A | N/A | 5301 | 5320 | CAGAACCATCTTTGTGACCC | 72 | 1834 |
| 1238949 | N/A | N/A | 5410 | 5429 | AACTCATACATACAGACGCA | 37 | 1835 |
| 1238971 | N/A | N/A | 5481 | 5500 | GCTTCCAGCTTCTTAATGCA | 78 | 1836 |
| 1238993 | N/A | N/A | 5634 | 5653 | TAATTTTCTTAGCTACTGCC | 60 | 1837 |
| 1239015 | N/A | N/A | 5682 | 5701 | ATCATGATTTTAGTGGTTA | 26 | 1838 |
| 1239037 | N/A | N/A | 5733 | 5752 | TAACCCACTTTTTTACTTGT | 97 | 1839 |
| 1239059 | N/A | N/A | 5831 | 5850 | AGATCACCGACAATTTCAAT | 53 | 1840 |
| 1239081 | N/A | N/A | 5961 | 5980 | GTAGCAAATATAACAATCTC | 43 | 1841 |
| 1239103 | N/A | N/A | 6271 | 6290 | CATTTGGTGACTTTCAACCT | 65 | 1842 |
| 1239125 | N/A | N/A | 6423 | 6442 | ATTCTAAAAATCTGTGGCCA | 92 | 1843 |
| 1239147 | N/A | N/A | 6494 | 6513 | TCTGTTATGTTATTATTGTT | 38 | 1844 |
| 1239169 | N/A | N/A | 6683 | 6702 | AGATACAGACATGTTTTGAA | 30 | 1845 |
| 1239191 | N/A | N/A | 6854 | 6873 | GATTACCTCCCTTAAAGTGA | 78 | 1846 |
| 1239213 | N/A | N/A | 7186 | 7205 | GTTATATTTTAATTTTCTGA | 42 | 1847 |
| 1239235 | N/A | N/A | 7433 | 7452 | CCGTTCATCTTATTCCCATT | 28 | 1848 |
| 1239257 | N/A | N/A | 8085 | 8104 | TCTTGGCTAAATTTATTCTG | 37 | 1849 |
| 1239279 | N/A | N/A | 8313 | 8332 | CAAAGATGCCACCTTCACCC | 98 | 1850 |
| 1239301 | N/A | N/A | 8618 | 8637 | AAAGATCATTTACTATGATA | 115 | 1851 |
| 1239323 | N/A | N/A | 8976 | 8995 | ACTTACACTTCACTTAGACC | 64 | 1852 |
| 1239345 | N/A | N/A | 9353 | 9372 | TGGTAGTTTTTCAAATCAAC | 12 | 1853 |
| 1239367 | N/A | N/A | 9526 | 9545 | CACAAAGCCCAAGATATCAT | 81 | 1854 |
| 1239389 | N/A | N/A | 9846 | 9865 | CACACTTAGCCACCCTGCCA | 130 | 1855 |
| 1239411 | N/A | N/A | 10656 | 10675 | TAGCTTGGTGGGCTTAAGGA | 86 | 1856 |
| 1239433 | N/A | N/A | 10761 | 10780 | TGGCACAATAATTTATTGAT | 97 | 1857 |
| 1239455 | N/A | N/A | 12370 | 12389 | CCAATTCTACATGTTCTCAT | 60 | 1858 |
| 1239477 | N/A | N/A | 13521 | 13540 | GCACATAGAAAATCCAACAG | 61 | 1859 |
| 1239499 | N/A | N/A | 13734 | 13753 | GGCATATTTCAAGATATCCT | 34 | 1860 |
| 1239521 | N/A | N/A | 14119 | 14138 | GCCAGCTAACATTTTCAATT | 43 | 1861 |

TABLE 25-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1239543 | N/A | N/A | 14366 | 14385 | CTTATTATTCATGTTCTCCA | 46 | 1862 |
| 1239565 | N/A | N/A | 14531 | 14550 | CCTAGAAGGCTTTTCTTCCA | 80 | 1863 |
| 1239587 | N/A | N/A | 14902 | 14921 | TACATTGGATCTATCAGCAA | 68 | 1864 |
| 1239609 | N/A | N/A | 15197 | 15216 | AGAGTTAAAGTACTCAGGTC | 65 | 1865 |
| 1239631 | N/A | N/A | 15303 | 15322 | AATAAATAAATTAACATCCT | 109 | 1866 |
| 1239653 | N/A | N/A | 15409 | 15428 | TTTATCACCCAATTAGCTGC | 76 | 1867 |
| 1239675 | N/A | N/A | 15456 | 15475 | CTGTTGCCAATTTTAGAACA | 118 | 1868 |
| 1239697 | N/A | N/A | 15658 | 15677 | CTGGAACACTGAAGTTAGTC | 68 | 1869 |
| 1239719 | N/A | N/A | 15729 | 15748 | CTGCTGTACCCTAGGTCAAA | 66 | 1870 |
| 1239741 | N/A | N/A | 15816 | 15835 | TTTCAAATTAAAGATCTCAT | 103 | 1871 |
| 1239763 | N/A | N/A | 15849 | 15868 | GGAGAATGTACATTCATCAA | 82 | 1872 |
| 1239785 | N/A | N/A | 15904 | 15923 | TTGTACCAAAACAACAAACA | 105 | 1873 |
| 1239807 | N/A | N/A | 16094 | 16113 | TGCTCAGTAGAAACACTGTT | 85 | 1874 |

TABLE 26

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1201142 | 1963 | 1982 | 17754 | 17773 | GCCACATATAGGGTCCTTTA | 11 | 66 |
| 1238136 | 69 | 88 | 3162 | 3181 | TGGCTCATTGACTGTAAAAA | 111 | 1875 |
| 1238158 | 142 | 161 | 3235 | 3254 | AAAAAACGAGTTGAGATTCG | 105 | 1876 |
| 1238180 | 602 626 | 621 645 | 16393 16417 | 16412 16436 | GCCACCACCATGAGGCTGCC | 102 | 1877 |
| 1238202 | 722 | 741 | 16513 | 16532 | CTTACTCGGCTTGTTCCACT | 87 | 1878 |
| 1238224 | 1182 | 1201 | 16973 | 16992 | AAGACCTTCCTCATCCCACT | 87 | 1879 |
| 1238246 | 1345 | 1364 | 17136 | 17155 | CAGGTCTACTCTATGTTTTC | 24 | 1880 |
| 1238268 | 1490 | 1509 | 17281 | 17300 | GAGATTTGTTTTAGCCTCAA | 27 | 1881 |
| 1238290 | 1657 | 1676 | 17448 | 17467 | TCATGTGGCCTCCTAACAAA | 29 | 1882 |
| 1238312 | 1769 | 1788 | 17560 | 17579 | CTGTGAAAAGTAAACATCA | 53 | 1883 |
| 1238334 | 1829 | 1848 | 17620 | 17639 | CCAGAGGTTCAGTGTTGTGA | 13 | 1884 |
| 1238356 | 1873 | 1892 | 17664 | 17683 | TTCATATATGTTACAGTTAT | 26 | 1885 |
| 1238378 | 1909 | 1928 | 17700 | 17719 | CATTCCCAAACATTTGATTT | 82 | 1886 |
| 1238400 | 1985 | 2004 | 17776 | 17795 | CCTATAGTTTAAAGAAAGGA | 96 | 1887 |
| 1238422 | 2024 | 2043 | 17815 | 17834 | GTGTCTAGAAGGCAATTTAC | 70 | 1888 |
| 1238444 | 2079 | 2098 | 17870 | 17889 | GTATGTCAAAATCATTCTGG | 16 | 1889 |
| 1238466 | 2113 | 2132 | 17904 | 17923 | ATGATGATGGTGCTTTCACA | 19 | 1890 |

TABLE 26-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1238488 | 2143 | 2162 | 17934 | 17953 | ACTGACCATTTTTAATTAC | 32 | 1891 |
| 1238510 | 2172 | 2191 | 17963 | 17982 | AGAAATGCAAGCAGTTCTTT | 40 | 1892 |
| 1238532 | 2230 | 2249 | 18021 | 18040 | TACAGAAACTATGAACTTGA | 36 | 1893 |
| 1238554 | 2264 | 2283 | 18055 | 18074 | GATTGTCTCCCTATTCTTTG | 22 | 1894 |
| 1238576 | 2297 | 2316 | 18088 | 18107 | ATTTCTGTCATCTCCAACCT | 34 | 1895 |
| 1238598 | 2321 | 2340 | 18112 | 18131 | CTTTTTCCACTTCAAATCAA | 48 | 1896 |
| 1238620 | 2364 | 2383 | 18155 | 18174 | AATTCAGGGAATAATTTTAC | 79 | 1897 |
| 1238642 | 2402 | 2421 | 18193 | 18212 | GAAAAGTAATACATATCTGC | 72 | 1898 |
| 1238664 | 2509 | 2528 | 18300 | 18319 | CTGCTCTAAACAAAACTCCT | 61 | 1899 |
| 1238686 | 2560 | 2579 | 18351 | 18370 | AAGTATTCAGTACCTTACAA | 44 | 1900 |
| 1238708 | 2708 | 2727 | 18499 | 18518 | AAGAACATGCAAAGTTACAA | 82 | 1901 |
| 1238730 | N/A | N/A | 4713 | 4732 | ATGAAGATCCTCATCATTAC | 82 | 1902 |
| 1238752 | N/A | N/A | 4812 | 4831 | TACCAGGAGTTTTCCCTAAG | 73 | 1903 |
| 1238774 | N/A | N/A | 4850 | 4869 | TTTGATAATTATATTTGTAA | 123 | 1904 |
| 1238796 | N/A | N/A | 4891 | 4910 | CAGAAGTTTAACATATTTAT | 74 | 1905 |
| 1238818 | N/A | N/A | 4956 | 4975 | ATTGCTCCTTTCCACTGGTG | 32 | 1906 |
| 1238840 | N/A | N/A | 5008 | 5027 | ACTGGTTAGCTTTTTTTCAC | 29 | 1907 |
| 1238862 | N/A | N/A | 5066 | 5085 | GTGTTAGATATAAATAACAT | 94 | 1908 |
| 1238884 | N/A | N/A | 5118 | 5137 | TTGCCATTTATCTATTATAA | 47 | 1909 |
| 1238906 | N/A | N/A | 5163 | 5182 | AAACATGCTCTAATTTGCAT | 79 | 1910 |
| 1238928 | N/A | N/A | 5302 | 5321 | GCAGAACCATCTTTGTGACC | 51 | 1911 |
| 1238950 | N/A | N/A | 5413 | 5432 | AATAACTCATACATACAGAC | 60 | 1912 |
| 1238972 | N/A | N/A | 5490 | 5509 | TGGGTCACAGCTTCCAGCTT | 60 | 1913 |
| 1238994 | N/A | N/A | 5638 | 5657 | GTCATAATTTTCTTAGCTAC | 12 | 1914 |
| 1239016 | N/A | N/A | 5684 | 5703 | AAATCATGATTTTTAGTGGT | 55 | 1915 |
| 1239038 | N/A | N/A | 5735 | 5754 | AATAACCCACTTTTTTACTT | 80 | 1916 |
| 1239060 | N/A | N/A | 5839 | 5858 | GAAAATTAAGATCACCGACA | 26 | 1917 |
| 1239082 | N/A | N/A | 5974 | 5993 | TCTTTTATTCTAAGTAGCAA | 72 | 1918 |
| 1239104 | N/A | N/A | 6288 | 6307 | ACCCTCATTTTCTGTGACAT | 61 | 1919 |
| 1239126 | N/A | N/A | 6424 | 6443 | AATTCTAAAAATCTGTGGCC | 84 | 1920 |
| 1239148 | N/A | N/A | 6499 | 6518 | AAACTTCTGTTATGTTATTA | 75 | 1921 |
| 1239170 | N/A | N/A | 6684 | 6703 | TAGATACAGACATGTTTTGA | 58 | 1922 |
| 1239192 | N/A | N/A | 6855 | 6874 | GGATTACCTCCCTTAAAGTG | 62 | 1923 |
| 1239214 | N/A | N/A | 7189 | 7208 | CTTGTTATATTTTAATTTTC | 113 | 1924 |
| 1239236 | N/A | N/A | 7588 | 7607 | GAAGAAAATTTTTAATGAGA | 114 | 1925 |
| 1239258 | N/A | N/A | 8159 | 8178 | TATCTTTCTATTTGTGTCTC | 39 | 1926 |

TABLE 26-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1239280 | N/A | N/A | 8314 | 8333 | ACAAAGATGCCACCTTCACC | 82 | 1927 |
| 1239302 | N/A | N/A | 8639 | 8658 | GCAAATTCAACAGCTCATTA | 39 | 1928 |
| 1239324 | N/A | N/A | 8981 | 9000 | ATCAGACTTACACTTCACTT | 55 | 1929 |
| 1239346 | N/A | N/A | 9354 | 9373 | GTGGTAGTTTTTCAAATCAA | 12 | 1930 |
| 1239368 | N/A | N/A | 9536 | 9555 | CTGTCACAAACACAAAGCCC | 79 | 1931 |
| 1239390 | N/A | N/A | 9847 | 9866 | GCACACTTAGCCACCCTGCC | 112 | 1932 |
| 1239412 | N/A | N/A | 10675 | 10694 | CAGTTTTGAATAAGATACTT | 77 | 1933 |
| 1239434 | N/A | N/A | 10780 | 10799 | ATTATTGTGCCACCAAGCCT | 129 | 1934 |
| 1239456 | N/A | N/A | 12378 | 12397 | CAGAAAACCCAATTCTACAT | 107 | 1935 |
| 1239478 | N/A | N/A | 13522 | 13541 | TGCACATAGAAAATCCAACA | 70 | 1936 |
| 1239500 | N/A | N/A | 13735 | 13754 | TGGCATATTTCAAGATATCC | 44 | 1937 |
| 1239522 | N/A | N/A | 14135 | 14154 | AGTATTTTTGACAATGGCCA | 61 | 1938 |
| 1239544 | N/A | N/A | 14367 | 14386 | GCTTATTATTCATGTTCTCC | 13 | 1939 |
| 1239566 | N/A | N/A | 14579 | 14598 | TGACAAGCCCATCCTGTCTC | 102 | 1940 |
| 1239588 | N/A | N/A | 14918 | 14937 | ATTTCTCTCCCAGCATACA | 109 | 1941 |
| 1239610 | N/A | N/A | 15203 | 15222 | ACAAGCAGAGTTAAAGTACT | 77 | 1942 |
| 1239632 | N/A | N/A | 15332 | 15351 | CTGGATAATATTCATAAAAA | 95 | 1943 |
| 1239654 | N/A | N/A | 15410 | 15429 | CTTTATCACCCAATTAGCTG | 73 | 1944 |
| 1239676 | N/A | N/A | 15458 | 15477 | AACTGTTGCCAATTTTAGAA | 86 | 1945 |
| 1239698 | N/A | N/A | 15663 | 15682 | ATATACTGGAACACTGAAGT | 61 | 1946 |
| 1239720 | N/A | N/A | 15732 | 15751 | TACCTGCTGTACCCTAGGTC | 86 | 1947 |
| 1239742 | N/A | N/A | 15819 | 15838 | TCTTTTCAAATTAAAGATCT | 105 | 1948 |
| 1239764 | N/A | N/A | 15850 | 15869 | TGGAGAATGTACATTCATCA | 33 | 1949 |
| 1239786 | N/A | N/A | 15911 | 15930 | CTAATTTTTGTACCAAAACA | 106 | 1950 |
| 1239808 | N/A | N/A | 16116 | 16135 | AGTGCATAGCAATGGTATCA | 34 | 1951 |

TABLE 27

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1201142 | 1963 | 1982 | 17754 | 17773 | GCCACATATAGGGTCCTTTA | 8 | 66 |
| 1238119 | 48 | 67 | 3141 | 3160 | CATCTTTAATTGGAAATTCG | 98 | 1952 |
| 1238141 | 109 | 128 | 3202 | 3221 | ATCAGTTGATACCGCCTGCG | 120 | 1953 |
| 1238163 | 457 | 476 | 16248 | 16267 | CATGTGGCCACAAAGAGAAC | 54* | 1954 |
| 1238185 | 590 614 | 609 633 | 16381 16405 | 16400 16424 | AGGCTGCCCCCAGCCACCAC | 98 | 1955 |

TABLE 27-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1238207 | 789 | 808 | 16580 | 16599 | CGCCAAGGCCCCCCACCACT | 64 | 1956 |
| 1238229 | 1187 | 1206 | 16978 | 16997 | ACAGGAAGACCTTCCTCATC | 86 | 1957 |
| 1238251 | 1385 | 1404 | 17176 | 17195 | CTCATGATGAACTCAATCAA | 58 | 1958 |
| 1238273 | 1585 | 1604 | 17376 | 17395 | CTATGAAATCTCTACTAAGA | 66 | 1959 |
| 1238295 | 1666 | 1685 | 17457 | 17476 | GAATAAGTATCATGTGGCCT | 35 | 1960 |
| 1238317 | 1807 | 1826 | 17598 | 17617 | ATATTTACTCTTGTTGAACA | 55 | 1961 |
| 1238339 | 1851 | 1870 | 17642 | 17661 | TCACTGTGAATATGTCCTCT | 9 | 1962 |
| 1238361 | 1879 | 1898 | 17670 | 17689 | AAGCCTTTCATATATGTTAC | 18 | 1963 |
| 1238383 | 1917 | 1936 | 17708 | 17727 | AAGGGCACCATTCCCAAACA | 106 | 1964 |
| 1238405 | 2000 | 2019 | 17791 | 17810 | CAGCTGCCTTAATTACCTAT | 20 | 1965 |
| 1238427 | 2039 | 2058 | 17830 | 17849 | GGAGATTTGCCTTCAGTGTC | 29 | 1966 |
| 1238449 | 2088 | 2107 | 17879 | 17898 | AGCTCTCCTGTATGTCAAAA | 17 | 1967 |
| 1238471 | 2123 | 2142 | 17914 | 17933 | ATCATCCTCTATGATGATGG | 101 | 1968 |
| 1238493 | 2152 | 2171 | 17943 | 17962 | TCTTTGCACACTGACCATTT | 15 | 1969 |
| 1238515 | 2199 | 2218 | 17990 | 18009 | TTTTTGACAATTATGAGACA | 54 | 1970 |
| 1238537 | 2242 | 2261 | 18033 | 18052 | TCAAAAGCCAATTACAGAAA | 78 | 1971 |
| 1238559 | 2272 | 2291 | 18063 | 18082 | ATTTTTTAGATTGTCTCCCT | 43 | 1972 |
| 1238581 | 2302 | 2321 | 18093 | 18112 | ATCATATTTCTGTCATCTCC | 23 | 1973 |
| 1238603 | 2331 | 2350 | 18122 | 18141 | AACAGAATTTCTTTTTCCAC | 43 | 1974 |
| 1238625 | 2377 | 2396 | 18168 | 18187 | GACAATATCAAACAATTCAG | 22 | 1975 |
| 1238647 | 2425 | 2444 | 18216 | 18235 | TGCAAGCCAATAATAACATT | 25 | 1976 |
| 1238669 | 2521 | 2540 | 18312 | 18331 | TTCAGATGTTAACTGCTCTA | 35 | 1977 |
| 1238691 | 2579 | 2598 | 18370 | 18389 | AAAGGGTTTCCCACATATTA | 49 | 1978 |
| 1238713 | 2722 | 2741 | 18513 | 18532 | TTATATAACAAAACAAGAAC | 88 | 1979 |
| 1238735 | N/A | N/A | 4743 | 4762 | ATGCTCTCAGAACAAGAAAA | 53 | 1980 |
| 1238757 | N/A | N/A | 4824 | 4843 | TTAATCCTATTCTACCAGGA | 78 | 1981 |
| 1238779 | N/A | N/A | 4871 | 4890 | CCAATTCCCTGTTCCTATGT | 42 | 1982 |
| 1238801 | N/A | N/A | 4901 | 4920 | TTGATTTTTCCAGAAGTTTA | 36 | 1983 |
| 1238823 | N/A | N/A | 4963 | 4982 | AAGTAAAATTGCTCCTTTCC | 58 | 1984 |
| 1238845 | N/A | N/A | 5040 | 5059 | CACATCCTACCCCTCTGCCT | 95 | 1985 |
| 1238867 | N/A | N/A | 5096 | 5115 | TTAATATTTTCCTTTCGGTG | 33 | 1986 |
| 1238889 | N/A | N/A | 5124 | 5143 | ATCATTTTGCCATTTATCTA | 24 | 1987 |
| 1238911 | N/A | N/A | 5179 | 5198 | TGTAAAATGATAACCCAAAC | 63 | 1988 |
| 1238933 | N/A | N/A | 5324 | 5343 | GTCCAAGGTCACAAAATTGA | 74 | 1989 |
| 1238955 | N/A | N/A | 5425 | 5444 | CGAAATGCCCCCAATAACTC | 51 | 1990 |
| 1238977 | N/A | N/A | 5572 | 5591 | TAGATCATTCTGCTAGGAAT | 35 | 1991 |
| 1238999 | N/A | N/A | 5644 | 5663 | TAATGTGTCATAATTTTCTT | 64 | 1992 |

TABLE 27-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1239021 | N/A | N/A | 5703 | 5722 | CCACATATCACAGGCTCCAA | 31 | 1993 |
| 1239043 | N/A | N/A | 5742 | 5761 | TGCAGTTAATAACCCACTTT | 44 | 1994 |
| 1239065 | N/A | N/A | 5861 | 5880 | GAGAGCAATATATTCACCAA | 20 | 1995 |
| 1239087 | N/A | N/A | 6040 | 6059 | ACTAAATCATTAATCAACTA | 91 | 1996 |
| 1239109 | N/A | N/A | 6306 | 6325 | TGATCACAGCCTTTCCTGAC | 69 | 1997 |
| 1239131 | N/A | N/A | 6431 | 6450 | TCAGCATAATTCTAAAAATC | 95 | 1998 |
| 1239153 | N/A | N/A | 6507 | 6526 | TGGTGCAGAAACTTCTGTTA | 69 | 1999 |
| 1239175 | N/A | N/A | 6713 | 6732 | ATTTTATAATGCTGTAGCCA | 40 | 2000 |
| 1239197 | N/A | N/A | 6861 | 6880 | ACTGAAGGATTACCTCCCTT | 64 | 2001 |
| 1239219 | N/A | N/A | 7227 | 7246 | CATAATGTCCCTTGTCTCTT | 56 | 2002 |
| 1239241 | N/A | N/A | 7709 | 7728 | TCTAATTTTGTACACAATAC | 61 | 2003 |
| 1239263 | N/A | N/A | 8168 | 8187 | AGCACAGGCTATCTTTCTAT | 29 | 2004 |
| 1239285 | N/A | N/A | 8347 | 8366 | ATTGAGAGCTTTTCCTCTTA | 106 | 2005 |
| 1239307 | N/A | N/A | 8655 | 8674 | ACAAAATTCTAGCGAAGCAA | 75 | 2006 |
| 1239329 | N/A | N/A | 9039 | 9058 | GCTTTGGATCTCTTAGATTT | 14 | 2007 |
| 1239351 | N/A | N/A | 9417 | 9436 | TATAATTTTTTTACCTGGAA | 58 | 2008 |
| 1239373 | N/A | N/A | 9636 | 9655 | ATGAAAATCAATATCATTCC | 80 | 2009 |
| 1239395 | N/A | N/A | 10022 | 10041 | TAGACATGTAAACTTTGCCA | 37 | 2010 |
| 1239417 | N/A | N/A | 10722 | 10741 | AGTGTCAGAATTCTAAGGGT | 36 | 2011 |
| 1239439 | N/A | N/A | 10797 | 10816 | TAGGTGACCCACAACACATT | 96 | 2012 |
| 1239461 | N/A | N/A | 12469 | 12488 | AGTGTGGTACATATATGCTA | 50 | 2013 |
| 1239483 | N/A | N/A | 13544 | 13563 | CTATTTGCAATTAGTGTGAT | 84 | 2014 |
| 1239505 | N/A | N/A | 13778 | 13797 | CTAAGATACTCTCTGTCACC | 63 | 2015 |
| 1239527 | N/A | N/A | 14191 | 14210 | TACTAAATATTTATAATGGA | 103 | 2016 |
| 1239549 | N/A | N/A | 14372 | 14391 | TCTGTGCTTATTATTCATGT | 51 | 2017 |
| 1239571 | N/A | N/A | 14799 | 14818 | CCATCACTTCTCACCTGATT | 73 | 2018 |
| 1239593 | N/A | N/A | 14927 | 14946 | AGTGACTGAATTTTCTCTCC | 66 | 2019 |
| 1239615 | N/A | N/A | 15238 | 15257 | GTGGTCATAAGCAAATCAAA | 44 | 2020 |
| 1239637 | N/A | N/A | 15362 | 15381 | TTTTCATCTCCTTCAGAGCT | 60 | 2021 |
| 1239659 | N/A | N/A | 15417 | 15436 | CCCTTACCTTTATCACCCAA | 76 | 2022 |
| 1239681 | N/A | N/A | 15508 | 15527 | CCATGTACAGTTCAATGGTT | 102 | 2023 |
| 1239703 | N/A | N/A | 15683 | 15702 | GCCGTAAAACCTATAATGGC | 87 | 2024 |
| 1239725 | N/A | N/A | 15748 | 15767 | AATGATTGCTAAACAGTACC | 75 | 2025 |
| 1239747 | N/A | N/A | 15830 | 15849 | AATCAAAAATCTCTTTTCAA | 97 | 2026 |
| 1239769 | N/A | N/A | 15874 | 15893 | CCAGAATGACAATTTATGAC | 34 | 2027 |
| 1239791 | N/A | N/A | 15926 | 15945 | GTGAATTATTTTCTTCTAAT | 35 | 2028 |

TABLE 28

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1201142 | 1963 | 1982 | 17754 | 17773 | GCCACATATAGGGTCCTTTA | 11 | 66 |
| 1238120 | 49 | 68 | 3142 | 3161 | TCATCTTTAATTGGAAATTC | 95 | 2029 |
| 1238142 | 113 | 132 | 3206 | 3225 | TTGCATCAGTTGATACCGCC | 121 | 2030 |
| 1238164 | 458 | 477 | 16249 | 16268 | CCATGTGGCCACAAAGAGAA | 32* | 2031 |
| 1238186 | 591 | 610 | 16382 | 16401 | GAGGCTGCCCCCAGCCACCA | 79 | 2032 |
|  | 615 | 634 | 16406 | 16425 |  |  |  |
| 1238208 | 856 | 875 | 16647 | 16666 | TAACGGTCCTCATAGTCACT | 63 | 2033 |
| 1238230 | 1189 | 1208 | 16980 | 16999 | AAACAGGAAGACCTTCCTCA | 82 | 2034 |
| 1238252 | 1397 | 1416 | 17188 | 17207 | CATTAGCAACGGCTCATGAT | 75 | 2035 |
| 1238274 | 1586 | 1605 | 17377 | 17396 | GCTATGAAATCTCTACTAAG | 15 | 2036 |
| 1238296 | 1676 | 1695 | 17467 | 17486 | GGATTTTTTGAATAAGTAT | 31 | 2037 |
| 1238318 | 1808 | 1827 | 17599 | 17618 | AATATTTACTCTTGTTGAAC | 72 | 2038 |
| 1238340 | 1852 | 1871 | 17643 | 17662 | TTCACTGTGAATATGTCCTC | 20 | 2039 |
| 1238362 | 1881 | 1900 | 17672 | 17691 | AGAAGCCTTTCATATATGTT | 26 | 2040 |
| 1238384 | 1918 | 1937 | 17709 | 17728 | CAAGGGCACCATTCCCAAAC | 102 | 2041 |
| 1238406 | 2001 | 2020 | 17792 | 17811 | TCAGCTGCCTTAATTACCTA | 25 | 2042 |
| 1238428 | 2040 | 2059 | 17831 | 17850 | AGGAGATTTGCCTTCAGTGT | 35 | 2043 |
| 1238450 | 2090 | 2109 | 17881 | 17900 | GCAGCTCTCCTGTATGTCAA | 28 | 2044 |
| 1238472 | 2124 | 2143 | 17915 | 17934 | CATCATCCTCTATGATGATG | 104 | 2045 |
| 1238494 | 2153 | 2172 | 17944 | 17963 | TTCTTTGCACACTGACCATT | 31 | 2046 |
| 1238516 | 2200 | 2219 | 17991 | 18010 | GTTTTTGACAATTATGAGAC | 16 | 2047 |
| 1238538 | 2243 | 2262 | 18034 | 18053 | TTCAAAAGCCAATTACAGAA | 58 | 2048 |
| 1238560 | 2273 | 2292 | 18064 | 18083 | TATTTTTTAGATTGTCTCCC | 44 | 2049 |
| 1238582 | 2303 | 2322 | 18094 | 18113 | AATCATATTTCTGTCATCTC | 20 | 2050 |
| 1238604 | 2332 | 2351 | 18123 | 18142 | TAACAGAATTTCTTTTTCCA | 32 | 2051 |
| 1238626 | 2378 | 2397 | 18169 | 18188 | TGACAATATCAAACAATTCA | 48 | 2052 |
| 1238648 | 2427 | 2446 | 18218 | 18237 | AGTGCAAGCCAATAATAACA | 34 | 2053 |
| 1238670 | 2523 | 2542 | 18314 | 18333 | ACTTCAGATGTTAACTGCTC | 21 | 2054 |
| 1238692 | 2602 | 2621 | 18393 | 18412 | ATTGTAAGCCTAAGGACCAC | 49 | 2055 |
| 1238714 | 2723 | 2742 | 18514 | 18533 | TTTATATAACAAAACAAGAA | 89 | 2056 |
| 1238736 | N/A | N/A | 4744 | 4763 | GATGCTCTCAGAACAAGAAA | 49 | 2057 |
| 1238758 | N/A | N/A | 4826 | 4845 | CCTTAATCCTATTCTACCAG | 78 | 2058 |
| 1238780 | N/A | N/A | 4874 | 4893 | TATCCAATTCCCTGTTCCTA | 48 | 2059 |
| 1238802 | N/A | N/A | 4902 | 4921 | GTTGATTTTTCCAGAAGTTT | 9 | 2060 |
| 1238824 | N/A | N/A | 4964 | 4983 | TAAGTAAAATTGCTCCTTTC | 76 | 2061 |
| 1238846 | N/A | N/A | 5042 | 5061 | ATCACATCCTACCCCTCTGC | 77 | 2062 |
| 1238868 | N/A | N/A | 5097 | 5116 | CTTAATATTTTCCTTTCGGT | 37 | 2063 |

TABLE 28-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1238890 | N/A | N/A | 5125 | 5144 | CATCATTTGCCATTTATCT | 30 | 2064 |
| 1238912 | N/A | N/A | 5183 | 5202 | TAGATGTAAAATGATAACCC | 43 | 2065 |
| 1238934 | N/A | N/A | 5345 | 5364 | GATCAGGAAATTAGGTAGCC | 39 | 2066 |
| 1238956 | N/A | N/A | 5426 | 5445 | TCGAAATGCCCCCAATAACT | 59 | 2067 |
| 1238978 | N/A | N/A | 5577 | 5596 | AATTTTAGATCATTCTGCTA | 82 | 2068 |
| 1239000 | N/A | N/A | 5650 | 5669 | TTCAGTTAATGTGTCATAAT | 22 | 2069 |
| 1239022 | N/A | N/A | 5704 | 5723 | CCCACATATCACAGGCTCCA | 59 | 2070 |
| 1239044 | N/A | N/A | 5746 | 5765 | CAGGTGCAGTTAATAACCCA | 70 | 2071 |
| 1239066 | N/A | N/A | 5862 | 5881 | TGAGAGCAATATATTCACCA | 15 | 2072 |
| 1239088 | N/A | N/A | 6041 | 6060 | TACTAAATCATTAATCAACT | 117 | 2073 |
| 1239110 | N/A | N/A | 6307 | 6326 | GTGATCACAGCCTTTCCTGA | 83 | 2074 |
| 1239132 | N/A | N/A | 6432 | 6451 | TTCAGCATAATTCTAAAAAT | 102 | 2075 |
| 1239154 | N/A | N/A | 6508 | 6527 | GTGGTGCAGAAACTTCTGTT | 64 | 2076 |
| 1239176 | N/A | N/A | 6721 | 6740 | TAGGAGTTATTTTATAATGC | 39 | 2077 |
| 1239198 | N/A | N/A | 6872 | 6891 | TAATGCTTTTCACTGAAGGA | 57 | 2078 |
| 1239220 | N/A | N/A | 7254 | 7273 | ATGTCAAACAACCCCCGACC | 108 | 2079 |
| 1239242 | N/A | N/A | 7714 | 7733 | CTCTTTCTAATTTTGTACAC | 101 | 2080 |
| 1239264 | N/A | N/A | 8182 | 8201 | ATTATCCCCCATGAGCACA | 58 | 2081 |
| 1239286 | N/A | N/A | 8348 | 8367 | AATTGAGAGCTTTTCCTCTT | 99 | 2082 |
| 1239308 | N/A | N/A | 8660 | 8679 | TCTTAACAAAATTCTAGCGA | 107 | 2083 |
| 1239330 | N/A | N/A | 9064 | 9083 | AAGGTAATTTTATAACCCCC | 69 | 2084 |
| 1239352 | N/A | N/A | 9418 | 9437 | GTATAATTTTTTACCTGGA | 8 | 2085 |
| 1239374 | N/A | N/A | 9640 | 9659 | TTCAATGAAAATCAATATCA | 101 | 2086 |
| 1239396 | N/A | N/A | 10037 | 10056 | CCAAGAGTTTCAGTATAGAC | 16 | 2087 |
| 1239418 | N/A | N/A | 10734 | 10753 | ACACACATTTCAAGTGTCAG | 54 | 2088 |
| 1239440 | N/A | N/A | 10811 | 10830 | GCCACAGCTATATATAGGTG | 104 | 2089 |
| 1239462 | N/A | N/A | 12545 | 12564 | TCATTGCAAAACTATCCACA | 77 | 2090 |
| 1239484 | N/A | N/A | 13546 | 13565 | CACTATTTGCAATTAGTGTG | 82 | 2091 |
| 1239506 | N/A | N/A | 13779 | 13798 | TCTAAGATACTCTCTGTCAC | 79 | 2092 |
| 1239528 | N/A | N/A | 14210 | 14229 | AAGGAATAATCAAACTAAAT | 94 | 2093 |
| 1239550 | N/A | N/A | 14382 | 14401 | TGTTATTTCCTCTGTGCTTA | 33 | 2094 |
| 1239572 | N/A | N/A | 14802 | 14821 | CTTCCATCACTTCTCACCTG | 70 | 2095 |
| 1239594 | N/A | N/A | 14928 | 14947 | GAGTGACTGAATTTTCTCTC | 107 | 2096 |
| 1239616 | N/A | N/A | 15267 | 15286 | ACATTATTGAAATGGGAAGT | 50 | 2097 |
| 1239638 | N/A | N/A | 15363 | 15382 | TTTTTCATCTCCTTCAGAGC | 74 | 2098 |
| 1239660 | N/A | N/A | 15418 | 15437 | CCCCTTACCTTTATCACCCA | 119 | 2099 |
| 1239682 | N/A | N/A | 15516 | 15535 | ACCATATACCATGTACAGTT | 7 | 2100 |

TABLE 28-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) RTS 42354 | SEQ ID NO |
|---|---|---|---|---|---|---|---|
| 1239704 | N/A | N/A | 15686 | 15705 | TGTGCCGTAAAACCTATAAT | 69 | 2101 |
| 1239726 | N/A | N/A | 15749 | 15768 | AAATGATTGCTAAACAGTAC | 78 | 2102 |
| 1239748 | N/A | N/A | 15831 | 15850 | AAATCAAAAATCTCTTTTCA | 135 | 2103 |
| 1239770 | N/A | N/A | 15875 | 15894 | TCCAGAATGACAATTTATGA | 57 | 2104 |
| 1239792 | N/A | N/A | 15928 | 15947 | GAGTGAATTATTTTCTTCTA | 16 | 2105 |

TABLE 29

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5 to 3') | PRNP (% UTC) RTS 42354 | SEQ ID NO |
|---|---|---|---|---|---|---|---|
| 1201142 | 1963 | 1982 | 17754 | 17773 | GCCACATATAGGGTCCTTTA | 13 | 66 |
| 1238121 | 50 | 69 | 3143 | 3162 | ATCATCTTTAATTGGAAATT | 106 | 2106 |
| 1238143 | 117 | 136 | 3210 | 3229 | ACACTTGCATCAGTTGATAC | 126 | 2107 |
| 1238165 | 467 | 486 | 16258 | 16277 | CAGGTCACTCCATGTGGCCA | 91* | 2108 |
| 1238187 | 592 616 | 611 635 | 16383 16407 | 16402 16426 | TGAGGCTGCCCCCAGCCACC | 103 | 2109 |
| 1238209 | 857 | 876 | 16648 | 16667 | GTAACGGTCCTCATAGTCAC | 83 | 2110 |
| 1238231 | 1197 | 1216 | 16988 | 17007 | GATGGTGAAAACAGGAAGAC | 82 | 2111 |
| 1238253 | 1419 | 1438 | 17210 | 17229 | TGTTATACTTTTACTGGCCT | 57 | 2112 |
| 1238275 | 1588 | 1607 | 17379 | 17398 | TAGCTATGAAATCTCTACTA | 42 | 2113 |
| 1238297 | 1677 | 1696 | 17468 | 17487 | AGGATTTTTTTGAATAAGTA | 51 | 2114 |
| 1238319 | 1810 | 1829 | 17601 | 17620 | ACAATATTTACTCTTGTTGA | 31 | 2115 |
| 1238341 | 1853 | 1872 | 17644 | 17663 | GTTCACTGTGAATATGTCCT | 4 | 2116 |
| 1238363 | 1882 | 1901 | 17673 | 17692 | CAGAAGCCTTTCATATATGT | 25 | 2117 |
| 1238385 | 1919 | 1938 | 17710 | 17729 | CCAAGGGCACCATTCCCAAA | 87 | 2118 |
| 1238407 | 2002 | 2021 | 17793 | 17812 | TTCAGCTGCCTTAATTACCT | 38 | 2119 |
| 1238429 | 2041 | 2060 | 17832 | 17851 | AAGGAGATTTGCCTTCAGTG | 53 | 2120 |
| 1238451 | 2091 | 2110 | 17882 | 17901 | TGCAGCTCTCCTGTATGTCA | 32 | 2121 |
| 1238473 | 2125 | 2144 | 17916 | 17935 | ACATCATCCTCTATGATGAT | 107 | 2122 |
| 1238495 | 2154 | 2173 | 17945 | 17964 | TTTCTTTGCACACTGACCAT | 29 | 2123 |
| 1238517 | 2201 | 2220 | 17992 | 18011 | GGTTTTTGACAATTATGAGA | 4 | 2124 |
| 1238539 | 2245 | 2264 | 18036 | 18055 | GATTCAAAAGCCAATTACAG | 43 | 2125 |
| 1238561 | 2274 | 2293 | 18065 | 18084 | ATATTTTTAGATTGTCTCC | 52 | 2126 |
| 1238583 | 2304 | 2323 | 18095 | 18114 | CAATCATATTTCTGTCATCT | 26 | 2127 |
| 1238605 | 2333 | 2352 | 18124 | 18143 | TTAACAGAATTTCTTTTTCC | 58 | 2128 |
| 1238627 | 2379 | 2398 | 18170 | 18189 | GTGACAATATCAAACAATTC | 43 | 2129 |

TABLE 29-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5 to 3') | PRNP (% UTC) RTS 42354 | SEQ ID NO |
|---|---|---|---|---|---|---|---|
| 1238649 | 2429 | 2448 | 18220 | 18239 | AAAGTGCAAGCCAATAATAA | 60 | 2130 |
| 1238671 | 2525 | 2544 | 18316 | 18335 | ACACTTCAGATGTTAACTGC | 34 | 2131 |
| 1238693 | 2604 | 2623 | 18395 | 18414 | ACATTGTAAGCCTAAGGACC | 31 | 2132 |
| 1238715 | 2725 | 2744 | 18516 | 18535 | TTTTTATATAACAAAACAAG | 91 | 2133 |
| 1238737 | N/A | N/A | 4745 | 4764 | TGATGCTCTCAGAACAAGAA | 39 | 2134 |
| 1238759 | N/A | N/A | 4827 | 4846 | TCCTTAATCCTATTCTACCA | 92 | 2135 |
| 1238781 | N/A | N/A | 4875 | 4894 | TTATCCAATTCCCTGTTCCT | 67 | 2136 |
| 1238803 | N/A | N/A | 4903 | 4922 | TGTTGATTTTTCCAGAAGTT | 15 | 2137 |
| 1238825 | N/A | N/A | 4965 | 4984 | GTAAGTAAAATTGCTCCTTT | 35 | 2138 |
| 1238847 | N/A | N/A | 5044 | 5063 | AAATCACATCCTACCCCTCT | 80 | 2139 |
| 1238869 | N/A | N/A | 5098 | 5117 | TCTTAATATTTTCCTTTCGG | 30 | 2140 |
| 1238891 | N/A | N/A | 5131 | 5150 | ATGACTCATCATTTTGCCAT | 47 | 2141 |
| 1238913 | N/A | N/A | 5193 | 5212 | GTTATTTTAATAGATGTAAA | 106 | 2142 |
| 1238935 | N/A | N/A | 5379 | 5398 | TCATTTCCTCCATTCTATGA | 95 | 2143 |
| 1238957 | N/A | N/A | 5449 | 5468 | TTAACAAAATGTTTGTCACT | 71 | 2144 |
| 1238979 | N/A | N/A | 5579 | 5598 | CTAATTTTAGATCATTCTGC | 44 | 2145 |
| 1239001 | N/A | N/A | 5653 | 5672 | CATTTCAGTTAATGTGTCAT | 30 | 2146 |
| 1239023 | N/A | N/A | 5710 | 5729 | TTTTTCCCCACATATCACAG | 61 | 2147 |
| 1239045 | N/A | N/A | 5782 | 5801 | TCAGATTTTTCACATATGCG | 12 | 2148 |
| 1239067 | N/A | N/A | 5864 | 5883 | AGTGAGAGCAATATATTCAC | 70 | 2149 |
| 1239089 | N/A | N/A | 6054 | 6073 | CCAATACACAAATTACTAAA | 87 | 2150 |
| 1239111 | N/A | N/A | 6314 | 6333 | AGAGCTTGTGATCACAGCCT | 75 | 2151 |
| 1239133 | N/A | N/A | 6442 | 6461 | CCTTACATAATTCAGCATAA | 44 | 2152 |
| 1239155 | N/A | N/A | 6526 | 6545 | GCCATGTTCAGTGTCAGTGT | 34 | 2153 |
| 1239177 | N/A | N/A | 6723 | 6742 | CTTAGGAGTTATTTTATAAT | 81 | 2154 |
| 1239199 | N/A | N/A | 6874 | 6893 | TATAATGCTTTTCACTGAAG | 66 | 2155 |
| 1239221 | N/A | N/A | 7259 | 7278 | GGCAAATGTCAAACAACCCC | 80 | 2156 |
| 1239243 | N/A | N/A | 7715 | 7734 | TCTCTTTCTAATTTTGTACA | 97 | 2157 |
| 1239265 | N/A | N/A | 8187 | 8206 | CATTAATTATCCCCCCATGA | 65 | 2158 |
| 1239287 | N/A | N/A | 8393 | 8412 | CCACATATGACAAGGTCACA | 61 | 2159 |
| 1239309 | N/A | N/A | 8702 | 8721 | GCAGTATAGGCCAATATCCC | 47 | 2160 |
| 1239331 | N/A | N/A | 9065 | 9084 | AAAGGTAATTTTATAACCCC | 73 | 2161 |
| 1239353 | N/A | N/A | 9421 | 9440 | TAGGTATAATTTTTTTACCT | 111 | 2162 |
| 1239375 | N/A | N/A | 9650 | 9669 | TTGAAAAGTTTTCAATGAAA | 106 | 2163 |
| 1239397 | N/A | N/A | 10090 | 10109 | GCCATCTACTGAAATAGGAC | 105 | 2164 |
| 1239419 | N/A | N/A | 10735 | 10754 | AACACACATTTCAGTGTCA | 88 | 2165 |

TABLE 29-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5 to 3') | PRNP (% UTC) RTS 42354 | SEQ ID NO |
|---|---|---|---|---|---|---|---|
| 1239441 | N/A | N/A | 11088 | 11107 | GTACCATAACCTTTTTTTT | 40 | 2166 |
| 1239463 | N/A | N/A | 12638 | 12657 | CGGAAATATCATTCGACTCA | 47 | 2167 |
| 1239485 | N/A | N/A | 13548 | 13567 | GACACTATTTGCAATTAGTG | 91 | 2168 |
| 1239507 | N/A | N/A | 13780 | 13799 | ATCTAAGATACTCTCTGTCA | 120 | 2169 |
| 1239529 | N/A | N/A | 14213 | 14232 | CATAAGGAATAATCAAACTA | 102 | 2170 |
| 1239551 | N/A | N/A | 14383 | 14402 | ATGTTATTTCCTCTGTGCTT | 36 | 2171 |
| 1239573 | N/A | N/A | 14808 | 14827 | TCGGTGCTTCCATCACTTCT | 77 | 2172 |
| 1239595 | N/A | N/A | 14930 | 14949 | TAGAGTGACTGAATTTTCTC | 131 | 2173 |
| 1239617 | N/A | N/A | 15269 | 15288 | TAACATTATTGAAATGGGAA | 81 | 2174 |
| 1239639 | N/A | N/A | 15366 | 15385 | TTATTTTTCATCTCCTTCAG | 65 | 2175 |
| 1239661 | N/A | N/A | 15419 | 15438 | ACCCCTTACCTTTATCACCC | 75 | 2176 |
| 1239683 | N/A | N/A | 15517 | 15536 | CACCATATACCATGTACAGT | 22 | 2177 |
| 1239705 | N/A | N/A | 15687 | 15706 | GTGTGCCGTAAAACCTATAA | 51 | 2178 |
| 1239727 | N/A | N/A | 15761 | 15780 | ATGACAATAGTAAAATGATT | 98 | 2179 |
| 1239749 | N/A | N/A | 15832 | 15851 | CAAATCAAAAATCTCTTTTC | 97 | 2180 |
| 1239771 | N/A | N/A | 15877 | 15896 | CATCCAGAATGACAATTTAT | 95 | 2181 |
| 1239793 | N/A | N/A | 15932 | 15951 | TTATGAGTGAATTATTTTCT | 63 | 2182 |

TABLE 30

Reduction of PRNP RNA

| Compound ID | SEQ ID NO: 3 Start Site | SEQ ID NO: 3 Stop Site | Sequence (5' to 3') | PRNP (% UTC) | SEQ ID NO |
|---|---|---|---|---|---|
| 1238727 | 216 | 235 | TGCTCTGAAAAGCGAAGCCA | 97 | 2183 |

Example 2: Effect of 5-10-5 MOE Gapmers with Mixed Internucleoside Linkages on Human PRNP RNA In Vitro, Single Dose Modified oligonucleotides complementary to human PRNP nucleic acid were synthesized and tested for their effect on PRNP RNA levels in vitro.

The modified oligonucleotides in the tables below are 5-10-5 MOE gapmers with mixed internucleoside linkages.

The gapmers are 20 nucleosides in length, wherein the central gap segment consists of ten 2'-β-D-deoxynucleosides and the 3' and 5' wings each consist of five 2'-MOE modified nucleosides. The sugar motif of the gapmers is (from 5' to 3'): eeeeedddddddddeeeee; wherein "d" represents a 2'-β-D-deoxyribosyl sugar, and 'e' represents a 2'-MOE modified ribosyl sugar. The internucleoside linkage motif for the gapmers is (from 5' to 3'): sooossssssssssooss; wherein 'o' represents a phosphodiester internucleoside linkage and 's' represents a phosphorothioate internucleoside linkage. Each cytosine residue is a 5-methyl cytosine.

"Start site" indicates the 5'-most nucleoside to which the gapmer is complementary to in the human sequence. "Stop site" indicates the 3'-most nucleoside to which the gapmer is complementary to in the human sequence. Each modified oligonucleotide listed in the tables below is complementary to human PRNP nucleic acid sequences SEQ ID NO: 1 or SEQ ID NO: 2, as indicated. 'N/A' indicates that the modified oligonucleotide is not complementary to that particular nucleic acid with 100% complementarity. As shown below, modified oligonucleotides complementary to the nucleobase sequence of human PRNP reduced the amount of human PRNP RNA.

Cultured A-431 cells at a density of 20,000 cells per well were treated with 4,000 nM of modified oligonucleotide by free uptake. After a treatment period of approximately 48 hours, total RNA was isolated from the cells and PRNP RNA levels were measured by quantitative real-time RTPCR, using primer probe set RTS42354, as described in Example 1. PRNP RNA levels were normalized using RIBOGREENE. Results are presented in the tables below are normalized to PRNP RNA levels in untreated control cells (UTC). Values marked with an asterisk (*) result from oligonucleotides that are complementary to the amplicon region of the primer probe set. Additional assays may be used to measure the potency and efficacy of the modified oligonucleotides complementary to the amplicon region.

TABLE 31

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1201142 | 1963 | 1982 | 17754 | 17773 | GCCACATATAGGGTCCTTTA | 6 | 66 |
| 1270212 | 420 | 439 | 16211 | 16230 | GGTTCGCCATAATGACTGCT | 2* | 2184 |
| 1270213 | 423 | 442 | 16214 | 16233 | CAAGGTTCGCCATAATGACT | 23* | 2185 |
| 1270218 | 506 | 525 | 16297 | 16316 | GTTCCATCCTCCAGGCTTCG | 5* | 2186 |
| 1270219 | 507 | 526 | 16298 | 16317 | TGTTCCATCCTCCAGGCTTC | 11* | 2187 |
| 1270224 | 516 | 535 | 16307 | 16326 | TGCCCCCAGTGTTCCATCCT | 5* | 2188 |
| 1270225 | 517 | 536 | 16308 | 16327 | CTGCCCCCAGTGTTCCATCC | 5 | 2189 |
| 1270230 | 1335 | 1354 | 17126 | 17145 | CTATGTTTTCCAGTGCCCAT | 12 | 2190 |
| 1270231 | 1337 | 1356 | 17128 | 17147 | CTCTATGTTTTCCAGTGCCC | 4 | 2191 |
| 1270236 | 1425 | 1444 | 17216 | 17235 | ATTTGCTGTTATACTTTTAC | 6 | 2192 |
| 1270237 | 1426 | 1445 | 17217 | 17236 | TATTTGCTGTTATACTTTTA | 17 | 2193 |
| 1270242 | 1455 | 1474 | 17246 | 17265 | CCAAAAATAAGTCCAGATTA | 27 | 2194 |
| 1270243 | 1456 | 1475 | 17247 | 17266 | TCCAAAAATAAGTCCAGATT | 30 | 2195 |
| 1270248 | 1512 | 1531 | 17303 | 17322 | CAAAGGTATTTCAGACTGTT | 9 | 2196 |
| 1270249 | 1513 | 1532 | 17304 | 17323 | GCAAAGGTATTTCAGACTGT | 16 | 2197 |
| 1270254 | 1559 | 1578 | 17350 | 17369 | ATTAGTATACTGAGCTCTAG | 36 | 2198 |
| 1270255 | 1565 | 1584 | 17356 | 17375 | TAGGGCATTAGTATACTGAG | 3 | 2199 |
| 1270260 | 1618 | 1637 | 17409 | 17428 | GGTTTTCTTAAAATGGAAAA | 72 | 2200 |
| 1270261 | 1622 | 1641 | 17413 | 17432 | GTCGGGTTTTCTTAAAATGG | 10 | 2201 |
| 1270266 | 1827 | 1846 | 17618 | 17637 | AGAGGTTCAGTGTTGTGACA | 17 | 2202 |
| 1270267 | 1841 | 1860 | 17632 | 17651 | TATGTCCTCTAGCCAGAGGT | 75 | 2203 |
| 1270272 | 1856 | 1875 | 17647 | 17666 | TATGTTCACTGTGAATATGT | 26 | 2204 |
| 1270273 | 1871 | 1890 | 17662 | 17681 | CATATATGTTACAGTTATGT | 35 | 2205 |
| 1270278 | 1895 | 1914 | 17686 | 17705 | TGATTTCAAGTCCCAGAAGC | 23 | 2206 |
| 1270279 | 1960 | 1979 | 17751 | 17770 | ACATATAGGGTCCTTTAAAC | 55 | 2207 |
| 1270284 | 1971 | 1990 | 17762 | 17781 | AAAGGAATGCCACATATAGG | 16 | 2208 |
| 1270285 | 1973 | 1992 | 17764 | 17783 | AGAAAGGAATGCCACATATA | 32 | 2209 |
| 1270290 | 2006 | 2025 | 17797 | 17816 | ACTTTTCAGCTGCCTTAATT | 33 | 2210 |
| 1270291 | 2007 | 2026 | 17798 | 17817 | TACTTTTCAGCTGCCTTAAT | 30 | 2211 |
| 1270296 | 2072 | 2091 | 17863 | 17882 | AAAATCATTCTGGTTTCCAG | 22 | 2212 |
| 1270297 | 2073 | 2092 | 17864 | 17883 | CAAAATCATTCTGGTTTCCA | 20 | 2213 |
| 1270302 | 2150 | 2169 | 17941 | 17960 | TTTGCACACTGACCATTTTT | 42 | 2214 |
| 1270303 | 2151 | 2170 | 17942 | 17961 | CTTTGCACACTGACCATTTT | 26 | 2215 |
| 1270308 | 2202 | 2221 | 17993 | 18012 | TGGTTTTTGACAATTATGAG | 4 | 2216 |
| 1270309 | 2203 | 2222 | 17994 | 18013 | CTGGTTTTTGACAATTATGA | 2 | 2217 |
| 1270314 | 2290 | 2309 | 18081 | 18100 | TCATCTCCAACCTAAGATAT | 52 | 2218 |
| 1270315 | 2323 | 2342 | 18114 | 18133 | TTCTTTTTCCACTTCAAATC | 50 | 2219 |

TABLE 31-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270320 | 2358 | 2377 | 18149 | 18168 | GGGAATAATTTTACTTTAAT | 26 | 2220 |
| 1270321 | 2359 | 2378 | 18150 | 18169 | AGGGAATAATTTTACTTTAA | 14 | 2221 |
| 1270326 | 2419 | 2438 | 18210 | 18229 | CCAATAATAACATTGCAGAA | 18 | 2222 |
| 1270327 | 2421 | 2440 | 18212 | 18231 | AGCCAATAATAACATTGCAG | 9 | 2223 |
| 1270332 | 2573 | 2592 | 18364 | 18383 | TTTCCCACATATTAAGTATT | 43 | 2224 |
| 1270333 | 2577 | 2596 | 18368 | 18387 | AGGGTTTCCCACATATTAAG | 33 | 2225 |
| 1270338 | 2612 | 2631 | 18403 | 18422 | TTCAGTGCACATTGTAAGCC | 13 | 2226 |
| 1270339 | N/A | N/A | 4894 | 4913 | TTCCAGAAGTTTAACATATT | 29 | 2227 |
| 1270344 | N/A | N/A | 4908 | 4927 | AGCGTTGTTGATTTTTCCAG | 9 | 2228 |
| 1270350 | N/A | N/A | 4998 | 5017 | TTTTTTTCACTGTAAGACCT | 31 | 2229 |
| 1270356 | N/A | N/A | 5072 | 5091 | AGACTTGTGTTAGATATAAA | 35 | 2230 |
| 1270362 | N/A | N/A | 5081 | 5100 | CGGTGTGGAAGACTTGTGTT | 15 | 2231 |
| 1270368 | N/A | N/A | 5190 | 5209 | ATTTTAATAGATGTAAAATG | 97 | 2232 |
| 1270374 | N/A | N/A | 5517 | 5536 | CAGGTAAGTTCTCAGGAGTG | 12 | 2233 |
| 1270380 | N/A | N/A | 5530 | 5549 | GTTTCTTCCATTGCAGGTAA | 2 | 2234 |
| 1270386 | N/A | N/A | 5538 | 5557 | GTTTGTTTGTTTCTTCCATT | 2 | 2235 |
| 1270392 | N/A | N/A | 5607 | 5626 | TATACATTTAGGCTCTTTTC | 22 | 2236 |
| 1270398 | N/A | N/A | 5636 | 5655 | CATAATTTTCTTAGCTACTG | 32 | 2237 |
| 1270404 | N/A | N/A | 5674 | 5693 | TTTTAGTGGTTACATAATGT | 66 | 2238 |
| 1270410 | N/A | N/A | 5779 | 5798 | GATTTTTCACATATGCGTTC | 8 | 2239 |
| 1270416 | N/A | N/A | 5794 | 5813 | GTGCTTTTCCTTTCAGATTT | 21 | 2240 |
| 1270422 | N/A | N/A | 5855 | 5874 | AATATATTCACCAAAGGAAA | 63 | 2241 |
| 1270428 | N/A | N/A | 6216 | 6235 | ATCTGTTGTGGTTCAGCTAA | 42 | 2242 |
| 1270434 | N/A | N/A | 6224 | 6243 | TATGTACAATCTGTTGTGGT | 19 | 2243 |
| 1270440 | N/A | N/A | 6496 | 6515 | CTTCTGTTATGTTATTATTG | 34 | 2244 |
| 1270446 | N/A | N/A | 7280 | 7299 | TAATTAGTTACATCGGGAAG | 64 | 2245 |
| 1270452 | N/A | N/A | 7387 | 7406 | TAGTAAGAACTTATCCCAAG | 59 | 2246 |
| 1270458 | N/A | N/A | 8039 | 8058 | ATGGCACTTTCTTTTTATTT | 20 | 2247 |
| 1270464 | N/A | N/A | 8166 | 8185 | CACAGGCTATCTTTCTATTT | 46 | 2248 |
| 1270470 | N/A | N/A | 9024 | 9043 | GATTTTGGACGGGAGATTT | 57 | 2249 |
| 1270476 | N/A | N/A | 9034 | 9053 | GGATCTCTTAGATTTTGGA | 40 | 2250 |
| 1270482 | N/A | N/A | 9042 | 9061 | TTTGCTTTGGATCTCTTAGA | 23 | 2251 |
| 1270488 | N/A | N/A | 9358 | 9377 | CAGGGTGGTAGTTTTTCAAA | 10 | 2252 |
| 1270494 | N/A | N/A | 9686 | 9705 | ATTAATAGGTTAGGAAGAAA | 91 | 2253 |
| 1270500 | N/A | N/A | 9694 | 9713 | GGAGCTCTATTAATAGGTTA | 63 | 2254 |
| 1270506 | N/A | N/A | 9984 | 10003 | GTGGGAGTATCAATTTAAGC | 46 | 2255 |

TABLE 31-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270512 | N/A | N/A | 11334 | 11353 | TGTTGTTTCTTTTCTGGTAG | 12 | 2256 |
| 1270518 | N/A | N/A | 14380 | 14399 | TTATTTCCTCTGTGCTTATT | 54 | 2257 |
| 1270524 | N/A | N/A | 15164 | 15183 | TTTTTGGAGGCTCTTTTAGG | 53 | 2258 |
| 1270530 | N/A | N/A | 15515 | 15534 | CCATATACCATGTACAGTTC | 17 | 2259 |
| 1270536 | N/A | N/A | 15623 | 15642 | GGATGATCTGCAATTGTTTT | 24 | 2260 |

TABLE 32

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1201142 | 1963 | 1982 | 17754 | 17773 | GCCACATATAGGGTCCTTTA | 7 | 66 |
| 1270214 | 425 | 444 | 16216 | 16235 | GCCAAGGTTCGCCATAATGA | 10* | 2261 |
| 1270220 | 509 | 528 | 16300 | 16319 | AGTGTTCCATCCTCCAGGCT | 5* | 2262 |
| 1270226 | 518 | 537 | 16309 | 16328 | GCTGCCCCCAGTGTTCCATC | 12* | 2263 |
| 1270232 | 1338 | 1357 | 17129 | 17148 | ACTCTATGTTTTCCAGTGCC | 7 | 2264 |
| 1270238 | 1427 | 1446 | 17218 | 17237 | TTATTTGCTGTTATACTTTT | 31 | 2265 |
| 1270244 | 1458 | 1477 | 17249 | 17268 | AGTCCAAAAATAAGTCCAGA | 12 | 2266 |
| 1270250 | 1515 | 1534 | 17306 | 17325 | AGGCAAAGGTATTTCAGACT | 3 | 2267 |
| 1270256 | 1566 | 1585 | 17357 | 17376 | ATAGGGCATTAGTATACTGA | 5 | 2268 |
| 1270262 | 1623 | 1642 | 17414 | 17433 | TGTCGGGTTTTCTTAAAATG | 16 | 2269 |
| 1270268 | 1843 | 1862 | 17634 | 17653 | AATATGTCCTCTAGCCAGAG | 37 | 2270 |
| 1270274 | 1872 | 1891 | 17663 | 17682 | TCATATATGTTACAGTTATG | 22 | 2271 |
| 1270280 | 1961 | 1980 | 17752 | 17771 | CACATATAGGGTCCTTTAAA | 30 | 2272 |
| 1270286 | 1992 | 2011 | 17783 | 17802 | TTAATTACCTATAGTTTAAA | 42 | 2273 |
| 1270292 | 2008 | 2027 | 17799 | 17818 | TTACTTTTCAGCTGCCTTAA | 19 | 2274 |
| 1270298 | 2084 | 2103 | 17875 | 17894 | CTCCTGTATGTCAAAATCAT | 55 | 2275 |
| 1270304 | 2169 | 2188 | 17960 | 17979 | AATGCAAGCAGTTCTTTTCT | 14 | 2276 |
| 1270310 | 2204 | 2223 | 17995 | 18014 | TCTGGTTTTGACAATTATG | 3 | 2277 |
| 1270316 | 2324 | 2343 | 18115 | 18134 | TTTCTTTTTCCACTTCAAAT | 26 | 2278 |
| 1270322 | 2365 | 2384 | 18156 | 18175 | CAATTCAGGGAATAATTTTA | 61 | 2279 |
| 1270328 | 2423 | 2442 | 18214 | 18233 | CAAGCCAATAATAACATTGC | 28 | 2280 |
| 1270334 | 2605 | 2624 | 18396 | 18415 | CACATTGTAAGCCTAAGGAC | 20 | 2281 |
| 1270340 | N/A | N/A | 4897 | 4916 | TTTTTCCAGAAGTTAACAT | 69 | 2282 |
| 1270345 | N/A | N/A | 4910 | 4929 | AGAGCGTTGTTGATTTTTCC | 4 | 2283 |
| 1270346 | N/A | N/A | 4935 | 4954 | TTTTTTCCTTTCTTCTACAA | 117 | 2284 |
| 1270351 | N/A | N/A | 5000 | 5019 | GCTTTTTTTCACTGTAAGAC | 2 | 2285 |

TABLE 32-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270352 | N/A | N/A | 5001 | 5020 | AGCTTTTTTTCACTGTAAGA | 8 | 2286 |
| 1270357 | N/A | N/A | 5073 | 5092 | AAGACTTGTGTTAGATATAA | 24 | 2287 |
| 1270358 | N/A | N/A | 5074 | 5093 | GAAGACTTGTGTTAGATATA | 10 | 2288 |
| 1270363 | N/A | N/A | 5126 | 5145 | TCATCATTTTGCCATTTATC | 10 | 2289 |
| 1270364 | N/A | N/A | 5127 | 5146 | CTCATCATTTTGCCATTTAT | 7 | 2290 |
| 1270369 | N/A | N/A | 5192 | 5211 | TTATTTTAATAGATGTAAAA | 83 | 2291 |
| 1270370 | N/A | N/A | 5194 | 5213 | GGTTATTTTAATAGATGTAA | 4 | 2292 |
| 1270375 | N/A | N/A | 5519 | 5538 | TGCAGGTAAGTTCTCAGGAG | 12 | 2293 |
| 1270376 | N/A | N/A | 5521 | 5540 | ATTGCAGGTAAGTTCTCAGG | 7 | 2294 |
| 1270381 | N/A | N/A | 5532 | 5551 | TTGTTTCTTCCATTGCAGGT | 17 | 2295 |
| 1270382 | N/A | N/A | 5533 | 5552 | TTTGTTTCTTCCATTGCAGG | 27 | 2296 |
| 1270387 | N/A | N/A | 5540 | 5559 | TTGTTTGTTTGTTTCTTCCA | 4 | 2297 |
| 1270388 | N/A | N/A | 5597 | 5616 | GGCTCTTTTCCAGGTGTTCT | 9 | 2298 |
| 1270393 | N/A | N/A | 5608 | 5627 | TTATACATTTAGGCTCTTTT | 21 | 2299 |
| 1270394 | N/A | N/A | 5610 | 5629 | TGTTATACATTTAGGCTCTT | 8 | 2300 |
| 1270399 | N/A | N/A | 5637 | 5656 | TCATAATTTTCTTAGCTACT | 32 | 2301 |
| 1270400 | N/A | N/A | 5640 | 5659 | GTGTCATAATTTTCTTAGCT | 7 | 2302 |
| 1270405 | N/A | N/A | 5711 | 5730 | GTTTTTCCCCACATATCACA | 21 | 2303 |
| 1270406 | N/A | N/A | 5715 | 5734 | GTCAGTTTTTCCCCACATAT | 7 | 2304 |
| 1270411 | N/A | N/A | 5780 | 5799 | AGATTTTTCACATATGCGTT | 12 | 2305 |
| 1270412 | N/A | N/A | 5781 | 5800 | CAGATTTTTCACATATGCGT | 11 | 2306 |
| 1270417 | N/A | N/A | 5796 | 5815 | CTGTGCTTTTCCTTTCAGAT | 18 | 2307 |
| 1270418 | N/A | N/A | 5798 | 5817 | TTCTGTGCTTTTCCTTTCAG | 29 | 2308 |
| 1270423 | N/A | N/A | 5856 | 5875 | CAATATATTCACCAAAGGAA | 45 | 2309 |
| 1270424 | N/A | N/A | 5858 | 5877 | AGCAATATATTCACCAAAGG | 13 | 2310 |
| 1270429 | N/A | N/A | 6217 | 6236 | AATCTGTTGTGGTTCAGCTA | 18 | 2311 |
| 1270430 | N/A | N/A | 6218 | 6237 | CAATCTGTTGTGGTTCAGCT | 11 | 2312 |
| 1270435 | N/A | N/A | 6488 | 6507 | ATGTTATTATTGTTATTTGA | 42 | 2313 |
| 1270436 | N/A | N/A | 6490 | 6509 | TTATGTTATTATTGTTATTT | 71 | 2314 |
| 1270441 | N/A | N/A | 6498 | 6517 | AACTTCTGTTATGTTATTAT | 33 | 2315 |
| 1270442 | N/A | N/A | 6565 | 6584 | CAGAGAATCTTTCACCTTGG | 21 | 2316 |
| 1270447 | N/A | N/A | 7281 | 7300 | TTAATTAGTTACATCGGGAA | 31 | 2317 |
| 1270448 | N/A | N/A | 7285 | 7304 | AAGCTTAATTAGTTACATCG | 32 | 2318 |
| 1270453 | N/A | N/A | 7391 | 7410 | GAGCTAGTAAGAACTTATCC | 50 | 2319 |
| 1270454 | N/A | N/A | 7393 | 7412 | CAGAGCTAGTAAGAACTTAT | 26 | 2320 |
| 1270459 | N/A | N/A | 8041 | 8060 | AAATGGCACTTTCTTTTTAT | 20 | 2321 |

TABLE 32-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270460 | N/A | N/A | 8156 | 8175 | CTTTCTATTTGTGTCTCCTT | 22 | 2322 |
| 1270465 | N/A | N/A | 8167 | 8186 | GCACAGGCTATCTTTCTATT | 16 | 2323 |
| 1270466 | N/A | N/A | 8169 | 8188 | GAGCACAGGCTATCTTTCTA | 22 | 2324 |
| 1270471 | N/A | N/A | 9026 | 9045 | TAGATTTTTGGACGGGAGAT | 28 | 2325 |
| 1270472 | N/A | N/A | 9027 | 9046 | TTAGATTTTTGGACGGGAGA | 41 | 2326 |
| 1270477 | N/A | N/A | 9036 | 9055 | TTGGATCTCTTAGATTTTTG | 35 | 2327 |
| 1270483 | N/A | N/A | 9044 | 9063 | TGTTTGCTTTGGATCTCTTA | 20 | 2328 |
| 1270489 | N/A | N/A | 9413 | 9432 | ATTTTTTTACCTGGAAAATC | 72 | 2329 |
| 1270495 | N/A | N/A | 9687 | 9706 | TATTAATAGGTTAGGAAGAA | 70 | 2330 |
| 1270501 | N/A | N/A | 9696 | 9715 | CAGGAGCTCTATTAATAGGT | 24 | 2331 |
| 1270507 | N/A | N/A | 9985 | 10004 | AGTGGGAGTATCAATTTAAG | 42 | 2332 |
| 1270513 | N/A | N/A | 11337 | 11356 | TGTTGTTGTTTCTTTTCTGG | 7 | 2333 |
| 1270519 | N/A | N/A | 14381 | 14400 | GTTATTTCCTCTGTGCTTAT | 12 | 2334 |
| 1270525 | N/A | N/A | 15165 | 15184 | GTTTTTGGAGGCTCTTTTAG | 41 | 2335 |
| 1270531 | N/A | N/A | 15518 | 15537 | TCACCATATACCATGTACAG | 50 | 2336 |
| 1270537 | N/A | N/A | 15626 | 15645 | CTGGGATGATCTGCAATTGT | 40 | 2337 |

TABLE 33

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1201142 | 1963 | 1982 | 17754 | 17773 | GCCACATATAGGGTCCTTTA | 6 | 66 |
| 1270215 | 427 | 446 | 16218 | 16237 | CAGCCAAGGTTCGCCATAAT | 19* | 2338 |
| 1270216 | 503 | 522 | 16294 | 16313 | CCATCCTCCAGGCTTCGGGC | 13* | 2339 |
| 1270221 | 511 | 530 | 16302 | 16321 | CCAGTGTTCCATCCTCCAGG | 4* | 2340 |
| 1270222 | 514 | 533 | 16305 | 16324 | CCCCCAGTGTTCCATCCTCC | 6* | 2341 |
| 1270227 | 1331 | 1350 | 17122 | 17141 | GTTTTCCAGTGCCCATCAGT | 13 | 2342 |
| 1270228 | 1333 | 1352 | 17124 | 17143 | ATGTTTTCCAGTGCCCATCA | 9 | 2343 |
| 1270233 | 1339 | 1358 | 17130 | 17149 | TACTCTATGTTTTCCAGTGC | 19 | 2344 |
| 1270234 | 1422 | 1441 | 17213 | 17232 | TGCTGTTATACTTTTACTGG | 6 | 2345 |
| 1270239 | 1429 | 1448 | 17220 | 17239 | GGTTATTTGCTGTTATACTT | 3 | 2346 |
| 1270240 | 1452 | 1471 | 17243 | 17262 | AAAATAAGTCCAGATTAACC | 66 | 2347 |
| 1270245 | 1459 | 1478 | 17250 | 17269 | AAGTCCAAAATAAGTCCAG | 25 | 2348 |
| 1270246 | 1509 | 1528 | 17300 | 17319 | AGGTATTTCAGACTGTTCTG | 7 | 2349 |
| 1270251 | 1516 | 1535 | 17307 | 17326 | CAGGCAAAGGTATTTCAGAC | 14 | 2350 |
| 1270252 | 1517 | 1536 | 17308 | 17327 | CCAGGCAAAGGTATTTCAGA | 16 | 2351 |

TABLE 33-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270257 | 1567 | 1586 | 17358 | 17377 | GATAGGGCATTAGTATACTG | 4 | 2352 |
| 1270258 | 1569 | 1588 | 17360 | 17379 | AAGATAGGGCATTAGTATAC | 28 | 2353 |
| 1270263 | 1625 | 1644 | 17416 | 17435 | GTTGTCGGGTTTTCTTAAAA | 12 | 2354 |
| 1270264 | 1820 | 1839 | 17611 | 17630 | CAGTGTTGTGACAATATTTA | 7 | 2355 |
| 1270269 | 1844 | 1863 | 17635 | 17654 | GAATATGTCCTCTAGCCAGA | 23 | 2356 |
| 1270270 | 1849 | 1868 | 17640 | 17659 | ACTGTGAATATGTCCTCTAG | 6 | 2357 |
| 1270275 | 1878 | 1897 | 17669 | 17688 | AGCCTTTCATATATGTTACA | 18 | 2358 |
| 1270276 | 1880 | 1899 | 17671 | 17690 | GAAGCCTTTCATATATGTTA | 8 | 2359 |
| 1270281 | 1964 | 1983 | 17755 | 17774 | TGCCACATATAGGGTCCTTT | 5 | 2360 |
| 1270287 | 1999 | 2018 | 17790 | 17809 | AGCTGCCTTAATTACCTATA | 14 | 2361 |
| 1270293 | 2011 | 2030 | 17802 | 17821 | AATTTACTTTTCAGCTGCCT | 10 | 2362 |
| 1270299 | 2105 | 2124 | 17896 | 17915 | GGTGCTTTCACAACTGCAGC | 37 | 2363 |
| 1270305 | 2171 | 2190 | 17962 | 17981 | GAAATGCAAGCAGTTCTTTT | 23 | 2364 |
| 1270311 | 2206 | 2225 | 17997 | 18016 | ATTCTGGTTTTTGACAATTA | 11 | 2365 |
| 1270317 | 2325 | 2344 | 18116 | 18135 | ATTTCTTTTTCCACTTCAAA | 15 | 2366 |
| 1270323 | 2415 | 2434 | 18206 | 18225 | TAATAACATTGCAGAAAAGT | 65 | 2367 |
| 1270329 | 2569 | 2588 | 18360 | 18379 | CCACATATTAAGTATTCAGT | 3 | 2368 |
| 1270335 | 2606 | 2625 | 18397 | 18416 | GCACATTGTAAGCCTAAGGA | 2 | 2369 |
| 1270341 | N/A | N/A | 4900 | 4919 | TGATTTTTCCAGAAGTTTAA | 42 | 2370 |
| 1270347 | N/A | N/A | 4936 | 4955 | ATTTTTTCCTTTCTTCTACA | 78 | 2371 |
| 1270353 | N/A | N/A | 5010 | 5029 | TTACTGGTTAGCTTTTTTTC | 44 | 2372 |
| 1270359 | N/A | N/A | 5075 | 5094 | GGAAGACTTGTGTTAGATAT | 7 | 2373 |
| 1270365 | N/A | N/A | 5129 | 5148 | GACTCATCATTTTGCCATTT | 10 | 2374 |
| 1270371 | N/A | N/A | 5197 | 5216 | TTTGGTTATTTTAATAGATG | 62 | 2375 |
| 1270377 | N/A | N/A | 5522 | 5541 | CATTGCAGGTAAGTTCTCAG | 9 | 2376 |
| 1270383 | N/A | N/A | 5534 | 5553 | GTTTGTTTCTTCCATTGCAG | 8 | 2377 |
| 1270389 | N/A | N/A | 5603 | 5622 | CATTTAGGCTCTTTTCCAGG | 20 | 2378 |
| 1270395 | N/A | N/A | 5615 | 5634 | CCTGGTGTTATACATTTAGG | 68 | 2379 |
| 1270401 | N/A | N/A | 5665 | 5684 | TTACATAATGTTCATTTCAG | 50 | 2380 |
| 1270407 | N/A | N/A | 5722 | 5741 | TTTACTTGTCAGTTTTTCCC | 26 | 2381 |
| 1270413 | N/A | N/A | 5787 | 5806 | TCCTTTCAGATTTTTCACAT | 38 | 2382 |
| 1270419 | N/A | N/A | 5800 | 5819 | TTTTCTGTGCTTTTCCTTTC | 20 | 2383 |
| 1270425 | N/A | N/A | 5863 | 5882 | GTGAGAGCAATATATTCACC | 69 | 2384 |
| 1270431 | N/A | N/A | 6220 | 6239 | TACAATCTGTTGTGGTTCAG | 19 | 2385 |
| 1270437 | N/A | N/A | 6491 | 6510 | GTTATGTTATTATTGTTATT | 25 | 2386 |
| 1270443 | N/A | N/A | 6566 | 6585 | TCAGAGAATCTTTCACCTTG | 21 | 2387 |

TABLE 33-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270449 | N/A | N/A | 7288 | 7307 | TTGAAGCTTAATTAGTTACA | 22 | 2388 |
| 1270455 | N/A | N/A | 8035 | 8054 | CACTTTCTTTTTATTTCTTT | 23 | 2389 |
| 1270461 | N/A | N/A | 8158 | 8177 | ATCTTTCTATTTGTGTCTCC | 19

TABLE 34-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270235 | 1423 | 1442 | 17214 | 17233 | TTGCTGTTATACTTTTACTG | 6 | 2418 |
| 1270241 | 1454 | 1473 | 17245 | 17264 | CAAAAATAAGTCCAGATTAA | 60 | 2419 |
| 1270247 | 1511 | 1530 | 17302 | 17321 | AAAGGTATTTCAGACTGTTC | 9 | 2420 |
| 1270253 | 1519 | 1538 | 17310 | 17329 | ATCCAGGCAAAGGTATTTCA | 13 | 2421 |
| 1270259 | 1615 | 1634 | 17406 | 17425 | TTTCTTAAAATGGAAAATAT | 77 | 2422 |
| 1270265 | 1822 | 1841 | 17613 | 17632 | TTCAGTGTTGTGACAATATT | 5 | 2423 |
| 1270271 | 1850 | 1869 | 17641 | 17660 | CACTGTGAATATGTCCTCTA | 7 | 2424 |
| 1270277 | 1894 | 1913 | 17685 | 17704 | GATTTCAAGTCCCAGAAGCC | 21 | 2425 |
| 1270282 | 1966 | 1985 | 17757 | 17776 | AATGCCACATATAGGGTCCT | 13 | 2426 |
| 1270283 | 1970 | 1989 | 17761 | 17780 | AAGGAATGCCACATATAGGG | 6 | 2427 |
| 1270288 | 2004 | 2023 | 17795 | 17814 | TTTTCAGCTGCCTTAATTAC | 72 | 2428 |
| 1270289 | 2005 | 2024 | 17796 | 17815 | CTTTTCAGCTGCCTTAATTA | 56 | 2429 |
| 1270294 | 2065 | 2084 | 17856 | 17875 | TTCTGGTTTCCAGGTAAATG | 19 | 2430 |
| 1270295 | 2067 | 2086 | 17858 | 17877 | CATTCTGGTTTCCAGGTAAA | 13 | 2431 |
| 1270300 | 2144 | 2163 | 17935 | 17954 | CACTGACCATTTTTAATTA | 55 | 2432 |
| 1270301 | 2146 | 2165 | 17937 | 17956 | CACACTGACCATTTTTAAT | 32 | 2433 |
| 1270306 | 2196 | 2215 | 17987 | 18006 | TTGACAATTATGAGACAGAA | 8 | 2434 |
| 1270307 | 2198 | 2217 | 17989 | 18008 | TTTTGACAATTATGAGACAG | 17 | 2435 |
| 1270312 | 2269 | 2288 | 18060 | 18079 | TTTTAGATTGTCTCCCTATT | 50 | 2436 |
| 1270313 | 2288 | 2307 | 18079 | 18098 | ATCTCCAACCTAAGATATTT | 57 | 2437 |
| 1270318 | 2329 | 2348 | 18120 | 18139 | CAGAATTTCTTTTTCCACTT | 13 | 2438 |
| 1270319 | 2355 | 2374 | 18146 | 18165 | AATAATTTTACTTTAATTAA | 110 | 2439 |
| 1270324 | 2417 | 2436 | 18208 | 18227 | AATAATAACATTGCAGAAAA | 92 | 2440 |
| 1270325 | 2418 | 2437 | 18209 | 18228 | CAATAATAACATTGCAGAAA | 72 | 2441 |
| 1270330 | 2571 | 2590 | 18362 | 18381 | TCCCACATATTAAGTATTCA | 22 | 2442 |
| 1270331 | 2572 | 2591 | 18363 | 18382 | TTCCCACATATTAAGTATTC | 36 | 2443 |
| 1270336 | 2608 | 2627 | 18399 | 18418 | GTGCACATTGTAAGCCTAAG | 44 | 2444 |
| 1270337 | 2610 | 2629 | 18401 | 18420 | CAGTGCACATTGTAAGCCTA | 24 | 2445 |
| 1270342 | N/A | N/A | 4906 | 4925 | CGTTGTTGATTTTTCCAGAA | 2 | 2446 |
| 1270343 | N/A | N/A | 4907 | 4926 | GCGTTGTTGATTTTTCCAGA | 2 | 2447 |
| 1270348 | N/A | N/A | 4938 | 4957 | TGATTTTTCCTTTCTTCTA | 61 | 2448 |
| 1270349 | N/A | N/A | 4944 | 4963 | CACTGGTGATTTTTCCTTT | 44 | 2449 |
| 1270354 | N/A | N/A | 5011 | 5030 | CTTACTGGTTAGCTTTTTTT | 70 | 2450 |
| 1270355 | N/A | N/A | 5071 | 5090 | GACTTGTGTTAGATATAAAT | 30 | 2451 |
| 1270360 | N/A | N/A | 5078 | 5097 | TGTGGAAGACTTGTGTTAGA | 10 | 2452 |
| 1270361 | N/A | N/A | 5079 | 5098 | GTGTGGAAGACTTGTGTTAG | 24 | 2453 |

TABLE 34-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270366 | N/A | N/A | 5130 | 5149 | TGACTCATCATTTTGCCATT | 20 | 2454 |
| 1270367 | N/A | N/A | 5135 | 5154 | GTAAATGACTCATCATTTTG | 42 | 2455 |
| 1270372 | N/A | N/A | 5200 | 5219 | TATTTTGGTTATTTTAATAG | 122 | 2456 |
| 1270373 | N/A | N/A | 5515 | 5534 | GGTAAGTTCTCAGGAGTGGG | 22 | 2457 |
| 1270378 | N/A | N/A | 5523 | 5542 | CCATTGCAGGTAAGTTCTCA | 6 | 2458 |
| 1270379 | N/A | N/A | 5525 | 5544 | TTCCATTGCAGGTAAGTTCT | 24 | 2459 |
| 1270384 | N/A | N/A | 5536 | 5555 | TTGTTTGTTTCTTCCATTGC | 10 | 2460 |
| 1270385 | N/A | N/A | 5537 | 5556 | TTTGTTTGTTTCTTCCATTG | 7 | 2461 |
| 1270390 | N/A | N/A | 5604 | 5623 | ACATTTAGGCTCTTTTCCAG | 25 | 2462 |
| 1270391 | N/A | N/A | 5605 | 5624 | TACATTTAGGCTCTTTTCCA | 27 | 2463 |
| 1270396 | N/A | N/A | 5616 | 5635 | CCCTGGTGTTATACATTTAG | 73 | 2464 |
| 1270397 | N/A | N/A | 5618 | 5637 | TGCCCTGGTGTTATACATTT | 82 | 2465 |
| 1270402 | N/A | N/A | 5671 | 5690 | TAGTGGTTACATAATGTTCA | 12 | 2466 |
| 1270403 | N/A | N/A | 5673 | 5692 | TTTAGTGGTTACATAATGTT | 49 | 2467 |
| 1270408 | N/A | N/A | 5777 | 5796 | TTTTTCACATATGCGTTCAC | 24 | 2468 |
| 1270409 | N/A | N/A | 5778 | 5797 | ATTTTTCACATATGCGTTCA | 26 | 2469 |
| 1270414 | N/A | N/A | 5790 | 5809 | TTTTCCTTTCAGATTTTTCA | 46 | 2470 |
| 1270415 | N/A | N/A | 5793 | 5812 | TGCTTTTCCTTTCAGATTTT | 20 | 2471 |
| 1270420 | N/A | N/A | 5852 | 5871 | ATATTCACCAAAGGAAAATT | 68 | 2472 |
| 1270426 | N/A | N/A | 5867 | 5886 | CTTAGTGAGAGCAATATATT | 62 | 2473 |
| 1270432 | N/A | N/A | 6221 | 6240 | GTACAATCTGTTGTGGTTCA | 12 | 2474 |
| 1270438 | N/A | N/A | 6492 | 6511 | TGTTATGTTATTATTGTTAT | 34 | 2475 |
| 1270444 | N/A | N/A | 6571 | 6590 | GAAGTTCAGAGAATCTTTCA | 85 | 2476 |
| 1270450 | N/A | N/A | 7383 | 7402 | AAGAACTTATCCCAAGGTTG | 30 | 2477 |
| 1270456 | N/A | N/A | 8036 | 8055 | GCACTTTCTTTTTATTTCTT | 3 | 2478 |
| 1270462 | N/A | N/A | 8164 | 8183 | CAGGCTATCTTTCTATTTGT | 47 | 2479 |
| 1270468 | N/A | N/A | 8171 | 8190 | ATGAGCACAGGCTATCTTTC | 54 | 2480 |
| 1270474 | N/A | N/A | 9030 | 9049 | CTCTTAGATTTTGGACGGG | 6 | 2481 |
| 1270480 | N/A | N/A | 9040 | 9059 | TGCTTTGGATCTCTTAGATT | 11 | 2482 |
| 1270486 | N/A | N/A | 9352 | 9371 | GGTAGTTTTCAAATCAACA | 8 | 2483 |
| 1270492 | N/A | N/A | 9419 | 9438 | GGTATAATTTTTTTACCTGG | 54 | 2484 |
| 1270498 | N/A | N/A | 9690 | 9709 | CTCTATTAATAGGTTAGGAA | 60 | 2485 |
| 1270504 | N/A | N/A | 9980 | 9999 | GAGTATCAATTTAAGCAATT | 45 | 2486 |
| 1270510 | N/A | N/A | 11331 | 11350 | TGTTTCTTTTCTGGTAGAGA | 7 | 2487 |
| 1270516 | N/A | N/A | 14377 | 14396 | TTTCCTCTGTGCTTATTATT | 54 | 2488 |
| 1270522 | N/A | N/A | 15160 | 15179 | TGGAGGCTCTTTTAGGTGGG | 46 | 2489 |

TABLE 34-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270528 | N/A | N/A | 15513 | 15532 | ATATACCATGTACAGTTCAA | 40 | 2490 |
| 1270534 | N/A | N/A | 15619 | 15638 | GATCTGCAATTGTTTTCTC | 42 | 2491 |

TABLE 35

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1201142 | 1963 | 1982 | 17754 | 17773 | GCCACATATAGGGTCCTTTA | 6 | 66 |
| 1270421 | N/A | N/A | 5854 | 5873 | ATATATTCACCAAAGGAAAA | 73 | 2492 |
| 1270427 | N/A | N/A | 6214 | 6233 | CTGTTGTGGTTCAGCTAAAC | 32 | 2493 |
| 1270433 | N/A | N/A | 6222 | 6241 | TGTACAATCTGTTGTGGTTC | 24 | 2494 |
| 1270439 | N/A | N/A | 6495 | 6514 | TTCTGTTATGTTATTATTGT | 45 | 2495 |
| 1270445 | N/A | N/A | 6573 | 6592 | CTGAAGTTCAGAGAATCTTT | 50 | 2496 |
| 1270451 | N/A | N/A | 7386 | 7405 | AGTAAGAACTTATCCCAAGG | 28 | 2497 |
| 1270457 | N/A | N/A | 8037 | 8056 | GGCACTTTCTTTTTATTTCT | 8 | 2498 |
| 1270463 | N/A | N/A | 8165 | 8184 | ACAGGCTATCTTTCTATTTG | 27 | 2499 |
| 1270469 | N/A | N/A | 8173 | 8192 | CCATGAGCACAGGCTATCTT | 59 | 2500 |
| 1270475 | N/A | N/A | 9032 | 9051 | ATCTCTTAGATTTTGGACG | 38 | 2501 |
| 1270481 | N/A | N/A | 9041 | 9060 | TTGCTTTGGATCTCTTAGAT | 29 | 2502 |
| 1270487 | N/A | N/A | 9356 | 9375 | GGGTGGTAGTTTTTCAAATC | 30 | 2503 |
| 1270493 | N/A | N/A | 9420 | 9439 | AGGTATAATTTTTTTACCTG | 123 | 2504 |
| 1270499 | N/A | N/A | 9693 | 9712 | GAGCTCTATTAATAGGTTAG | 26 | 2505 |
| 1270505 | N/A | N/A | 9981 | 10000 | GGAGTATCAATTTAAGCAAT | 26 | 2506 |
| 1270511 | N/A | N/A | 11333 | 11352 | GTTGTTTCTTTTCTGGTAGA | 16 | 2507 |
| 1270517 | N/A | N/A | 14379 | 14398 | TATTTCCTCTGTGCTTATTA | 56 | 2508 |
| 1270523 | N/A | N/A | 15163 | 15182 | TTTTGGAGGCTCTTTTAGGT | 30 | 2509 |
| 1270529 | N/A | N/A | 15514 | 15533 | CATATACCATGTACAGTTCA | 48 | 2510 |
| 1270535 | N/A | N/A | 15621 | 15640 | ATGATCTGCAATTGTTTTTC | 37 | 2511 |
| 1270540 | 1560 | 1579 | 17351 | 17370 | CATTAGTATACTGAGCTCTA | 39 | 2512 |
| 1270541 | 1842 | 1861 | 17633 | 17652 | ATATGTCCTCTAGCCAGAGG | 81 | 2513 |
| 1270542 | 1959 | 1978 | 17750 | 17769 | CATATAGGGTCCTTTAAACA | 61 | 2514 |
| 1270543 | 2603 | 2622 | 18394 | 18413 | CATTGTAAGCCTAAGGACCA | 52 | 2515 |
| 1270544 | N/A | N/A | 6215 | 6234 | TCTGTTGTGGTTCAGCTAAA | 30 | 2516 |
| 1270545 | N/A | N/A | 7279 | 7298 | AATTAGTTACATCGGGAAGG | 50 | 2517 |
| 1270546 | N/A | N/A | 9025 | 9044 | AGATTTTGGACGGGAGATT | 38 | 2518 |
| 1270547 | 504 | 523 | 16295 | 16314 | TCCATCCTCCAGGCTTCGGG | 4* | 2519 |

TABLE 35-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270548 | 1332 | 1351 | 17123 | 17142 | TGTTTTCCAGTGCCCATCAG | 14 | 2520 |
| 1270549 | 1453 | 1472 | 17244 | 17263 | AAAAATAAGTCCAGATTAAC | 84 | 2521 |
| 1270550 | 1510 | 1529 | 17301 | 17320 | AAGGTATTTCAGACTGTTCT | 6 | 2522 |
| 1270551 | 1809 | 1828 | 17600 | 17619 | CAATATTTACTCTTGTTGAA | 54 | 2523 |
| 1270552 | 1993 | 2012 | 17784 | 17803 | CTTAATTACCTATAGTTTAA | 60 | 2524 |
| 1270553 | 2066 | 2085 | 17857 | 17876 | ATTCTGGTTTCCAGGTAAAT | 17 | 2525 |
| 1270554 | 2197 | 2216 | 17988 | 18007 | TTTGACAATTATGAGACAGA | 16 | 2526 |
| 1270555 | 2356 | 2375 | 18147 | 18166 | GAATAATTTTACTTTAATTA | 106 | 2527 |
| 1270556 | 2416 | 2435 | 18207 | 18226 | ATAATAACATTGCAGAAAAG | 63 | 2528 |
| 1270557 | 2570 | 2589 | 18361 | 18380 | CCCACATATTAAGTATTCAG | 19 | 2529 |
| 1270558 | N/A | N/A | 4898 | 4917 | ATTTTTCCAGAAGTTTAACA | 52 | 2530 |
| 1270559 | N/A | N/A | 5120 | 5139 | TTTTGCCATTTATCTATTAT | 53 | 2531 |
| 1270560 | N/A | N/A | 5516 | 5535 | AGGTAAGTTCTCAGGAGTGG | 14 | 2532 |
| 1270561 | N/A | N/A | 5531 | 5550 | TGTTTCTTCCATTGCAGGTA | 4 | 2533 |
| 1270562 | N/A | N/A | 5598 | 5617 | AGGCTCTTTTCCAGGTGTTC | 7 | 2534 |
| 1270563 | N/A | N/A | 5609 | 5628 | GTTATACATTTAGGCTCTTT | 2 | 2535 |
| 1270564 | N/A | N/A | 5635 | 5654 | ATAATTTTCTTAGCTACTGC | 37 | 2536 |
| 1270565 | N/A | N/A | 5791 | 5810 | CTTTTCCTTTCAGATTTTTC | 28 | 2537 |
| 1270566 | N/A | N/A | 5853 | 5872 | TATATTCACCAAAGGAAAAT | 89 | 2538 |
| 1270567 | N/A | N/A | 6489 | 6508 | TATGTTATTATTGTTATTTG | 79 | 2539 |
| 1270568 | N/A | N/A | 7384 | 7403 | TAAGAACTTATCCCAAGGTT | 29 | 2540 |
| 1270569 | N/A | N/A | 9035 | 9054 | TGGATCTCTTAGATTTTTGG | 26 | 2541 |
| 1270570 | N/A | N/A | 9979 | 9998 | AGTATCAATTTAAGCAATTG | 51 | 2542 |
| 1270571 | N/A | N/A | 14378 | 14397 | ATTTCCTCTGTGCTTATTAT | 40 | 2543 |
| 1270572 | N/A | N/A | 15512 | 15531 | TATACCATGTACAGTTCAAT | 33 | 2544 |
| 1270573 | 426 | 445 | 16217 | 16236 | AGCCAAGGTTCGCCATAATG | 20* | 2545 |
| 1270574 | 1568 | 1587 | 17359 | 17378 | AGATAGGGCATTAGTATACT | 21 | 2546 |
| 1270575 | 1972 | 1991 | 17763 | 17782 | GAAAGGAATGCCACATATAG | 33 | 2547 |
| 1270576 | 2611 | 2630 | 18402 | 18421 | TCAGTGCACATTGTAAGCCT | 11 | 2548 |
| 1270577 | N/A | N/A | 6223 | 6242 | ATGTACAATCTGTTGTGGTT | 10 | 2549 |
| 1270578 | N/A | N/A | 7287 | 7306 | TGAAGCTTAATTAGTTACAT | 38 | 2550 |
| 1270579 | 1340 | 1359 | 17131 | 17150 | CTACTCTATGTTTTCCAGTG | 5 | 2551 |
| 1270580 | 1428 | 1447 | 17219 | 17238 | GTTATTTGCTGTTATACTTT | 5 | 2552 |
| 1270581 | 1461 | 1480 | 17252 | 17271 | CTAAGTCCAAAAATAAGTCC | 54 | 2553 |
| 1270582 | 1518 | 1537 | 17309 | 17328 | TCCAGGCAAAGGTATTTCAG | 28 | 2554 |
| 1270583 | 1624 | 1643 | 17415 | 17434 | TTGTCGGGTTTTCTTAAAAT | 47 | 2555 |

TABLE 35-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270584 | 1828 | 1847 | 17619 | 17638 | CAGAGGTTCAGTGTTGTGAC | 5 | 2556 |
| 1270585 | 1857 | 1876 | 17648 | 17667 | TTATGTTCACTGTGAATATG | 31 | 2557 |
| 1270586 | 1883 | 1902 | 17674 | 17693 | CCAGAAGCCTTTCATATATG | 8 | 2558 |
| 1270587 | 1905 | 1924 | 17696 | 17715 | CCCAAACATTTGATTTCAAG | 67 | 2559 |
| 1270588 | 2083 | 2102 | 17874 | 17893 | TCCTGTATGTCAAAATCATT | 59 | 2560 |
| 1270589 | 2170 | 2189 | 17961 | 17980 | AAATGCAAGCAGTTCTTTTC | 44 | 2561 |
| 1270590 | 2424 | 2443 | 18215 | 18234 | GCAAGCCAATAATAACATTG | 9 | 2562 |
| 1270591 | 2578 | 2597 | 18369 | 18388 | AAGGGTTTCCCACATATTAA | 46 | 2563 |
| 1270592 | N/A | N/A | 4896 | 4915 | TTTTCCAGAAGTTTAACATA | 74 | 2564 |
| 1270593 | N/A | N/A | 5524 | 5543 | TCCATTGCAGGTAAGTTCTC | 28 | 2565 |
| 1270594 | N/A | N/A | 5606 | 5625 | ATACATTTAGGCTCTTTTCC | 22 | 2566 |
| 1270595 | N/A | N/A | 5617 | 5636 | GCCCTGGTGTTATACATTTA | 89 | 2567 |
| 1270596 | N/A | N/A | 5799 | 5818 | TTTCTGTGCTTTTCCTTTCA | 12 | 2568 |

TABLE 36

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1201142 | 1963 | 1982 | 17754 | 17773 | GCCACATATAGGGTCCTTTA | 6 | 66 |
| 1270597 | N/A | N/A | 5866 | 5885 | TTAGTGAGAGCAATATATTC | 63 | 2569 |
| 1270598 | N/A | N/A | 6497 | 6516 | ACTTCTGTTATGTTATTATT | 32 | 2570 |
| 1270599 | N/A | N/A | 6572 | 6591 | TGAAGTTCAGAGAATCTTTC | 110 | 2571 |
| 1270600 | N/A | N/A | 7392 | 7411 | AGAGCTAGTAAGAACTTATC | 49 | 2572 |
| 1270601 | N/A | N/A | 9043 | 9062 | GTTTGCTTTGGATCTCTTAG | 15 | 2573 |
| 1270602 | N/A | N/A | 9357 | 9376 | AGGGTGGTAGTTTTTCAAAT | 6 | 2574 |
| 1270603 | N/A | N/A | 9987 | 10006 | CAAGTGGGAGTATCAATTTA | 40 | 2575 |
| 1270604 | N/A | N/A | 15166 | 15185 | GGTTTTTGGAGGCTCTTTTA | 13 | 2576 |
| 1270605 | N/A | N/A | 15628 | 15647 | TGCTGGGATGATCTGCAATT | 69 | 2577 |
| 1270606 | 415 | 434 | N/A | N/A | GCCATAATGACTGCTCTGCC | 13* | 2578 |
| 1270607 | 1956 | 1975 | 17747 | 17766 | ATAGGGTCCTTTAAACATCT | 13 | 2579 |
| 1270608 | N/A | N/A | 6212 | 6231 | GTTGTGGTTCAGCTAAACTA | 66 | 2580 |
| 1270609 | N/A | N/A | 9022 | 9041 | TTTTTGGACGGGAGATTTAG | 73 | 2581 |
| 1270610 | N/A | N/A | 9684 | 9703 | TAATAGGTTAGGAAGAAAAG | 105 | 2582 |
| 1270611 | N/A | N/A | 9685 | 9704 | TTAATAGGTTAGGAAGAAAA | 88 | 2583 |
| 1270612 | 501 | 520 | 16292 | 16311 | ATCCTCCAGGCTTCGGGCGC | 16* | 2584 |
| 1270613 | 1417 | 1436 | 17208 | 17227 | TTATACTTTTACTGGCCTGG | 51 | 2585 |

TABLE 36-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270614 | 1450 | 1469 | 17241 | 17260 | AATAAGTCCAGATTAACCAA | 57 | 2586 |
| 1270615 | 1507 | 1526 | 17298 | 17317 | GTATTTCAGACTGTTCTGAG | 4 | 2587 |
| 1270616 | 1806 | 1825 | 17597 | 17616 | TATTTACTCTTGTTGAACAG | 40 | 2588 |
| 1270617 | 1891 | 1910 | 17682 | 17701 | TTCAAGTCCCAGAAGCCTTT | 20 | 2589 |
| 1270618 | 1892 | 1911 | 17683 | 17702 | TTTCAAGTCCCAGAAGCCTT | 18 | 2590 |
| 1270619 | 1990 | 2009 | 17781 | 17800 | AATTACCTATAGTTTAAAGA | 65 | 2591 |
| 1270620 | 2063 | 2082 | 17854 | 17873 | CTGGTTTCCAGGTAAATGGA | 21 | 2592 |
| 1270621 | 2100 | 2119 | 17891 | 17910 | TTTCACAACTGCAGCTCTCC | 41 | 2593 |
| 1270622 | 2194 | 2213 | 17985 | 18004 | GACAATTATGAGACAGAAAT | 11 | 2594 |
| 1270623 | 2286 | 2305 | 18077 | 18096 | CTCCAACCTAAGATATTTTT | 38 | 2595 |
| 1270624 | 2413 | 2432 | 18204 | 18223 | ATAACATTGCAGAAAAGTAA | 79 | 2596 |
| 1270625 | N/A | N/A | 4996 | 5015 | TTTTTCACTGTAAGACCTTC | 38 | 2597 |
| 1270626 | N/A | N/A | 4997 | 5016 | TTTTTTCACTGTAAGACCTT | 72 | 2598 |
| 1270627 | N/A | N/A | 5069 | 5088 | CTTGTGTTAGATATAAATAA | 74 | 2599 |
| 1270628 | N/A | N/A | 5070 | 5089 | ACTTGTGTTAGATATAAATA | 75 | 2600 |
| 1270629 | N/A | N/A | 5528 | 5547 | TTCTTCCATTGCAGGTAAGT | 19 | 2601 |
| 1270630 | N/A | N/A | 5595 | 5614 | CTCTTTTCCAGGTGTTCTAA | 12 | 2602 |
| 1270631 | N/A | N/A | 5632 | 5651 | ATTTTCTTAGCTACTGCCCT | 42 | 2603 |
| 1270632 | N/A | N/A | 5660 | 5679 | TAATGTTCATTTCAGTTAAT | 58 | 2604 |
| 1270633 | N/A | N/A | 5709 | 5728 | TTTTCCCCACATATCACAGG | 39 | 2605 |
| 1270634 | N/A | N/A | 5850 | 5869 | ATTCACCAAAGGAAAATTAA | 58 | 2606 |
| 1270635 | N/A | N/A | 6561 | 6580 | GAATCTTTCACCTTGGTTTG | 41 | 2607 |
| 1270636 | N/A | N/A | 7381 | 7400 | GAACTTATCCCAAGGTTGTA | 55 | 2608 |
| 1270637 | N/A | N/A | 8154 | 8173 | TTCTATTTGTGTCTCCTTGA | 32 | 2609 |
| 1270638 | N/A | N/A | 9411 | 9430 | TTTTTTACCTGGAAAATCTC | 84 | 2610 |
| 1270639 | N/A | N/A | 9976 | 9995 | ATCAATTTAAGCAATTGTTA | 58 | 2611 |
| 1270640 | N/A | N/A | 14375 | 14394 | TCCTCTGTGCTTATTATTCA | 50 | 2612 |
| 1270641 | N/A | N/A | 15509 | 15528 | ACCATGTACAGTTCAATGGT | 79 | 2613 |
| 1270642 | 1571 | 1590 | 17362 | 17381 | CTAAGATAGGGCATTAGTAT | 30 | 2614 |
| 1270643 | 1975 | 1994 | 17766 | 17785 | AAAGAAAGGAATGCCACATA | 30 | 2615 |
| 1270644 | 2614 | 2633 | 18405 | 18424 | GATTCAGTGCACATTGTAAG | 10 | 2616 |
| 1270645 | N/A | N/A | 6226 | 6245 | GATATGTACAATCTGTTGTG | 22 | 2617 |
| 1270646 | N/A | N/A | 9698 | 9717 | ATCAGGAGCTCTATTAATAG | 39 | 2618 |
| 1270647 | N/A | N/A | 9699 | 9718 | AATCAGGAGCTCTATTAATA | 55 | 2619 |
| 1270648 | 519 | 538 | 16310 | 16329 | GGCTGCCCCCAGTGTTCCAT | 27* | 2620 |
| 1270649 | 520 | 539 | 16311 | 16330 | CGGCTGCCCCCAGTGTTCCA | 36* | 2621 |

TABLE 36-continued

Reduction of PRNP RNA

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PRNP (% UTC) | SEQ ID NO |
|---|---|---|---|---|---|---|---|
| 1270650 | 1343 | 1362 | 17134 | 17153 | GGTCTACTCTATGTTTTCCA | 51 | 2622 |
| 1270651 | 1431 | 1450 | 17222 | 17241 | ATGGTTATTTGCTGTTATAC | 8 | 2623 |
| 1270652 | 1627 | 1646 | 17418 | 17437 | ATGTTGTCGGGTTTTCTTAA | 3 | 2624 |
| 1270653 | 1831 | 1850 | 17622 | 17641 | AGCCAGAGGTTCAGTGTTGT | 32 | 2625 |
| 1270654 | 1908 | 1927 | 17699 | 17718 | ATTCCCAAACATTTGATTTC | 83 | 2626 |
| 1270655 | 2086 | 2105 | 17877 | 17896 | CTCTCCTGTATGTCAAAATC | 66 | 2627 |
| 1270656 | 2114 | 2133 | 17905 | 17924 | TATGATGATGGTGCTTTCAC | 11 | 2628 |
| 1270657 | 2208 | 2227 | 17999 | 18018 | TAATTCTGGTTTTTGACAAT | 47 | 2629 |
| 1270658 | 2271 | 2290 | 18062 | 18081 | TTTTTTAGATTGTCTCCCTA | 56 | 2630 |
| 1270659 | 2581 | 2600 | 18372 | 18391 | CAAAAGGGTTTCCCACATAT | 27 | 2631 |
| 1270660 | N/A | N/A | 4947 | 4966 | TTCCACTGGTGATTTTTCC | 35 | 2632 |
| 1270661 | N/A | N/A | 4948 | 4967 | TTTCCACTGGTGATTTTTC | 52 | 2633 |
| 1270662 | N/A | N/A | 5012 | 5031 | CCTTACTGGTTAGCTTTTTT | 40 | 2634 |
| 1270663 | N/A | N/A | 5013 | 5032 | CCCTTACTGGTTAGCTTTTT | 49 | 2635 |
| 1270664 | N/A | N/A | 5083 | 5102 | TTCGGTGTGGAAGACTTGTG | 37 | 2636 |
| 1270665 | N/A | N/A | 5084 | 5103 | TTTCGGTGTGGAAGACTTGT | 41 | 2637 |
| 1270666 | N/A | N/A | 5527 | 5546 | TCTTCCATTGCAGGTAAGTT | 34 | 2638 |
| 1270667 | N/A | N/A | 5620 | 5639 | ACTGCCCTGGTGTTATACAT | 61 | 2639 |
| 1270668 | N/A | N/A | 5646 | 5665 | GTTAATGTGTCATAATTTTC | 23 | 2640 |
| 1270669 | N/A | N/A | 5675 | 5694 | TTTTTAGTGGTTACATAATG | 59 | 2641 |
| 1270670 | N/A | N/A | 5676 | 5695 | ATTTTTAGTGGTTACATAAT | 55 | 2642 |
| 1270671 | N/A | N/A | 5723 | 5742 | TTTTACTTGTCAGTTTTTCC | 16 | 2643 |
| 1270672 | N/A | N/A | 5724 | 5743 | TTTTTACTTGTCAGTTTTTC | 33 | 2644 |
| 1270673 | N/A | N/A | 5789 | 5808 | TTTCCTTTCAGATTTTTCAC | 47 | 2645 |

Example 3: Effect of Modified Oligonucleotides on Human PRNP RNA In Vitro, Multiple Doses Modified oligonucleotides selected from the examples above were tested at various doses in A-431 cells. Cells were plated at a density of 10,000 cells per well and treated with modified oligonucleotide at various doses by free uptake, as specified in the tables below. After a treatment period of approximately 48 hours, total RNA was isolated from the cells and PRNP RNA levels were measured by quantitative real-time PCR using primer probe set RTS42354 as described in Example 1. PRNP RNA levels were normalized with RIBOGREEN®. Results are presented in the tables below as percent PRNP RNA relative to untreated control cells (UTC). The half maximal inhibitory concentration (IC$_{50}$) of each modified oligonucleotide is also presented. IC$_{50}$ was calculated using a linear regression on a log/linear plot of the data in Excel. The modified oligonucleotides marked with an asterisk (*) are complementary to the amplicon region of the primer probe set. Additional assays may be used to measure the potency and efficacy of the modified oligonucleotides complementary to the amplicon region.

TABLE 37

Dose-dependent reduction of human PRNP RNA expression in A-431 cells

| Compound ID | % UTC | | | | | IC50 (µM) |
|---|---|---|---|---|---|---|
| | 23 nM | 94 nM | 375 nM | 1500 nM | 6000 nM | |
| 1201120 | 98 | 51 | 18 | 6 | 2 | 0.2 |
| 1201138 | 98 | 93 | 36 | 19 | 15 | 0.4 |
| 1201142 | 84 | 58 | 30 | 13 | 8 | 0.2 |
| 1201145 | 92 | 88 | 70 | 34 | 13 | 0.7 |
| 1201154 | 68 | 42 | 19 | 7 | 4 | 0.1 |
| 1201255 | 64 | 55 | 31 | 15 | 8 | 0.1 |
| 1201276 | 75 | 46 | 15 | 5 | 3 | 0.1 |

TABLE 37-continued

Dose-dependent reduction of human PRNP RNA expression in A-431 cells

| Compound ID | 23 nM | 94 nM | 375 nM | 1500 nM | 6000 nM | IC50 (µM) |
|---|---|---|---|---|---|---|
| 1201288 | 101 | 62 | 31 | 22 | 13 | 0.3 |
| 1201293 | 80 | 57 | 21 | 7 | 4 | 0.1 |
| 1201294 | 84 | 64 | 37 | 19 | 11 | 0.2 |
| 1238797 | 100 | 77 | 45 | 27 | 14 | 0.4 |
| 1238863 | 64 | 38 | 8 | 2 | 1 | 0.04 |
| 1238864 | 74 | 27 | 8 | 3 | 1 | 0.04 |
| 1238995 | 103 | 59 | 32 | 21 | 11 | 0.3 |
| 1200977* | 92 | 68 | 46 | 27 | 21 | 0.4 |

TABLE 38

Dose-dependent reduction of human PRNP RNA expression in A-431 cells

| Compound ID | 23 nM | 94 nM | 375 nM | 1500 nM | 6000 nM | IC50 (µM) |
|---|---|---|---|---|---|---|
| 1201142 | 82 | 58 | 30 | 13 | 7 | 0.2 |
| 1238270 | 77 | 57 | 30 | 12 | 8 | 0.1 |
| 1238359 | 83 | 57 | 31 | 12 | 4 | 0.2 |
| 1238360 | 102 | 65 | 41 | 22 | 13 | 0.4 |
| 1238490 | 79 | 53 | 36 | 12 | 7 | 0.1 |
| 1238491 | 95 | 77 | 46 | 41 | 17 | 0.5 |
| 1238600 | 93 | 76 | 55 | 29 | 16 | 0.5 |
| 1238645 | 92 | 65 | 57 | 32 | 20 | 0.5 |
| 1238688 | 87 | 81 | 96 | 32 | 31 | 1.4 |
| 1238974 | 50 | 48 | 17 | 8 | 4 | <0.02 |
| 1238975 | 82 | 67 | 41 | 22 | 11 | 0.3 |
| 1239062 | 87 | 76 | 56 | 28 | 13 | 0.4 |
| 1239063 | 179 | 72 | 37 | 16 | 5 | 0.6 |
| 1239064 | 96 | 95 | 59 | 27 | 10 | 0.6 |
| 1239260 | 98 | 79 | 56 | 35 | 26 | 0.7 |

TABLE 39

Dose-dependent reduction of human PRNP RNA expression in A-431 cells

| Compound ID | 23 nM | 94 nM | 375 nM | 1500 nM | 6000 nM | IC50 (µM) |
|---|---|---|---|---|---|---|
| 1201142 | 84 | 56 | 26 | 11 | 8 | 0.1 |
| 1238341 | 72 | 46 | 15 | 4 | 2 | 0.1 |
| 1238404 | 94 | 80 | 58 | 37 | 21 | 0.7 |
| 1238517 | 81 | 44 | 16 | 6 | 3 | 0.1 |
| 1238582 | 95 | 67 | 54 | 33 | 23 | 0.5 |
| 1238802 | 98 | 71 | 46 | 17 | 6 | 0.3 |
| 1238892 | 104 | 101 | 74 | 49 | 36 | 2 |
| 1238914 | 97 | 86 | 72 | 36 | 13 | 0.7 |
| 1239045 | 82 | 75 | 38 | 18 | 9 | 0.3 |
| 1239046 | 91 | 65 | 50 | 25 | 13 | 0.3 |
| 1239066 | 81 | 79 | 48 | 20 | 10 | 0.3 |
| 1239352 | 94 | 71 | 37 | 16 | 7 | 0.3 |
| 1239394 | 88 | 86 | 44 | 28 | 15 | 0.4 |
| 1239550 | 87 | 85 | 69 | 53 | 39 | 2.2 |
| 1239682 | 108 | 58 | 34 | 13 | 5 | 0.3 |

TABLE 40

Dose-dependent reduction of human PRNP RNA expression in A-431 cells

| Compound ID | 23 nM | 94 nM | 375 nM | 1500 nM | 6000 nM | IC50 (µM) |
|---|---|---|---|---|---|---|
| 1201142 | 83 | 55 | 23 | 17 | 7 | 0.1 |
| 1238167* | 63 | 41 | 18 | 13 | 9 | 0.04 |
| 1238168* | 72 | 44 | 17 | 17 | 12 | 0.1 |
| 1238169* | 76 | 41 | 21 | 17 | 11 | 0.1 |
| 1238170* | 69 | 35 | 18 | 10 | 8 | 0.05 |
| 1238255 | 91 | 59 | 29 | 15 | 9 | 0.2 |
| 1238322 | 67 | 31 | 9 | 4 | 1 | 0.03 |
| 1238324 | 91 | 69 | 32 | 13 | 5 | 0.2 |
| 1238409 | 72 | 61 | 40 | 14 | 8 | 0.2 |
| 1238410 | 87 | 67 | 33 | 18 | 8 | 0.2 |
| 1238497 | 86 | 65 | 31 | 14 | 8 | 0.2 |
| 1238498 | 81 | 65 | 34 | 16 | 9 | 0.2 |
| 1238500 | 82 | 36 | 15 | 5 | 2 | 0.1 |
| 1238805 | 85 | 58 | 30 | 12 | 5 | 0.2 |
| 1239027 | 67 | 60 | 33 | 17 | 13 | 0.1 |

TABLE 41

Dose-dependent reduction of human PRNP RNA expression in A-431 cells

| Compound ID | 23 nM | 94 nM | 375 nM | 1500 nM | 6000 nM | IC50 (µM) |
|---|---|---|---|---|---|---|
| 1201142 | 87 | 61 | 25 | 14 | 9 | 0.2 |
| 1238259 | 86 | 59 | 26 | 9 | 3 | 0.2 |
| 1238325 | 56 | 40 | 17 | 6 | 2 | 0.03 |
| 1238327 | 72 | 51 | 22 | 8 | 4 | 0.1 |
| 1238370 | 84 | 54 | 24 | 9 | 2 | 0.1 |
| 1238371 | 93 | 80 | 43 | 17 | 8 | 0.3 |
| 1238437 | 88 | 79 | 36 | 20 | 11 | 0.3 |
| 1238501 | 71 | 36 | 17 | 7 | 3 | 0.1 |
| 1238502 | 91 | 62 | 32 | 16 | 8 | 0.2 |
| 1239009 | 71 | 39 | 16 | 5 | 3 | 0.1 |
| 1239028 | 77 | 66 | 44 | 29 | 17 | 0.3 |
| 1239052 | 89 | 54 | 34 | 19 | 12 | 0.2 |
| 1239162 | 89 | 73 | 47 | 34 | 15 | 0.4 |
| 1239250 | 89 | 64 | 38 | 24 | 16 | 0.3 |
| 1239448 | 76 | 44 | 25 | 9 | 5 | 0.1 |

TABLE 42

Dose-dependent reduction of human PRNP RNA expression in A-431 cells

| Compound ID | 23 nM | 94 nM | 375 nM | 1500 nM | 6000 nM | IC50 (µM) |
|---|---|---|---|---|---|---|
| 1201142 | 90 | 52 | 33 | 12 | 8 | 0.2 |
| 1238285 | 97 | 84 | 55 | 36 | 14 | 0.6 |
| 1238329 | 90 | 49 | 25 | 12 | 6 | 0.1 |
| 1238373 | 75 | 60 | 11 | 9 | 4 | 0.1 |
| 1238440 | 74 | 61 | 26 | 12 | 8 | 0.1 |
| 1238460 | 85 | 77 | 46 | 30 | 13 | 0.4 |
| 1238572 | 96 | 82 | 60 | 39 | 29 | 0.9 |
| 1238812 | 100 | 51 | 34 | 11 | 6 | 0.2 |
| 1238813 | 88 | 64 | 41 | 21 | 17 | 0.3 |
| 1238835 | 109 | 80 | 43 | 20 | 8 | 0.4 |
| 1238836 | 78 | 61 | 35 | 11 | 6 | 0.2 |
| 1238990 | 81 | 62 | 33 | 15 | 7 | 0.2 |
| 1239010 | 76 | 38 | 15 | 6 | 1 | 0.1 |
| 1239011 | 97 | 68 | 36 | 16 | 7 | 0.3 |
| 1239231 | 85 | 96 | 76 | 52 | 30 | 1.8 |

TABLE 43

Dose-dependent reduction of human PRNP RNA expression in A-431 cells

| Compound ID | \% UTC | | | | | | IC50 (µM) |
|---|---|---|---|---|---|---|---|
| | 6 nM | 23 nM | 94 nM | 375 nM | 1500 nM | 6000 nM | |
| 1201142 | 94 | 97 | 62 | 27 | 14 | 7 | 0.2 |
| 1238244 | 92 | 106 | 61 | 31 | 15 | 12 | 0.2 |
| 1238331 | 107 | 116 | 64 | 28 | 14 | 8 | 0.3 |
| 1238507 | 92 | 66 | 39 | 25 | 9 | 5 | 0.1 |
| 1238616 | 109 | 91 | 70 | 56 | 35 | 29 | 0.7 |
| 1238837 | 90 | 70 | 50 | 15 | 9 | 4 | 0.1 |
| 1238838 | 88 | 92 | 53 | 31 | 18 | 9 | 0.2 |
| 1239146 | 109 | 100 | 61 | 44 | 23 | 11 | 0.3 |
| 1239607 | 97 | 86 | 66 | 39 | 23 | 18 | 0.3 |
| 1239694 | 110 | 108 | 84 | 76 | 48 | 28 | 1.5 |

TABLE 44

Dose-dependent reduction of human PRNP RNA expression in A-431 cells

| Compound ID | \% UTC | | | | | | IC50 (µM) |
|---|---|---|---|---|---|---|---|
| | 6 nM | 23 nM | 94 nM | 375 nM | 1500 nM | 6000 nM | |
| 1201142 | 105 | 98 | 69 | 27 | 20 | 10 | 0.3 |
| 1238361 | 88 | 86 | 53 | 31 | 20 | 10 | 0.5 |
| 1238444 | 107 | 96 | 83 | 51 | 39 | 21 | 0.6 |
| 1238554 | 96 | 91 | 85 | 67 | 44 | 31 | 1.3 |
| 1238889 | 99 | 85 | 88 | 61 | 59 | 39 | 2.6 |
| 1238992 | 84 | 101 | 73 | 51 | 31 | 20 | 0.5 |
| 1239263 | 89 | 100 | 92 | 69 | 48 | 32 | 1.8 |
| 1239329 | 106 | 96 | 80 | 47 | 39 | 31 | 0.8 |
| 1239345 | 120 | 113 | 90 | 49 | 30 | 19 | 0.6 |

Example 4: Design and Synthesis of MOE Gapmer Modified Oligonucleotides Complementary to a Human PRNP Nucleic Acid Modified oligonucleotides complementary to human PRNP nucleic acid were designed and synthesized.

"Start site" indicates the 5'-most nucleoside to which the gapmer is complementary to in the human gene sequence. "Stop site" indicates the 3'-most nucleoside to which the gapmer is complementary to in the human gene sequence. Most of the modified oligonucleotides listed in the Tables below are complementary to the human PRNP mRNA sequence, designated herein as SEQ ID NO: 1 (described here in above) and/or the human PRNP genomic sequence, designated herein as SEQ ID NO: 2 (described herein above). In addition, certain modified oligonucleotides are complementary to the human PRNP mRNA designated herein as SEQ ID NO: 4 (ENSEMBL Accession NO: ENST00000424424.1). 'N/A' indicates that the modified oligonucleotide is not complementary to that particular gene sequence with 100% complementarity.

The modified oligonucleotides in the table below are 3-10-7 MOE gapmers with mixed PO/PS internucleoside linkages. The gapmers are 20 nucleosides in length and have a central gap segment that consists of ten 2'-β-D-deoxynucleosides, a 5' wing segment that consists of three 2'-MOE nucleosides, and a 3' wing segment that consists of seven 2-MOE nucleosides. The sugar motif of the gapmers is (from 5' to 3'): eeedddddddddddeeeeeee; wherein 'd' represents a 2'-β-D-deoxyribosyl sugar, and 'e' represents a 2'-MOE modified ribosyl sugar. The gapmers have an internucleoside linkage motif of (from 5' to 3'): soossssssss-sooooss; wherein each "s" represents a phosphorothioate internucleoside linkage and each "o" represents a phosphodiester internucleoside linkage. Each cytosine nucleoside is a 5-methyl cytosine.

TABLE 45

3-10-7 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1373041 | GTCAGTTTTTCCCCACATAT | N/A | N/A | 5715 | 5734 | 2304 |
| 1373042 | ACTCTATGTTTTCCAGTGCC | 1338 | 1357 | 17129 | 17148 | 2264 |
| 1373043 | CTCTATGTTTTCCAGTGCCC | 1337 | 1356 | 17128 | 17147 | 2191 |
| 1373044 | CTATGTTTTCCAGTGCCCAT | 1335 | 1354 | 17126 | 17145 | 2190 |
| 1393331 | ACTGAATTTTCTCTCCCAGC | N/A | N/A | 14923 | 14942 | 2646 |
| 1393332 | GCCACATATAGGGTCCTTTA | 1963 | 1982 | 17754 | 17773 | 66 |
| 1411007 | CGTCCATTTTCTGTGCTTTT | N/A | N/A | 5806 | 5825 | 2647 |

The modified oligonucleotides in the table below are 4-10-6 MOE gapmers with mixed PO/PS internucleoside linkages. The gapmers are 20 nucleosides in length and have a central gap segment that consists of ten 2'-β-D-deoxynucleosides, a 5' wing segment that consists of four 2'-MOE nucleosides, and a 3' wing segment that consists of six 2'-MOE nucleosides. The sugar motif of the gapmers is (from 5' to 3'): eeeeddddddddddeeeeee; wherein 'd' represents a 2'-β-D-deoxyribosyl sugar, and 'e' represents a 2'-MOE modified ribosyl sugar. The gapmers have an internucleoside linkage motif of (from 5' to 3'): sooosssssssss-soooss; wherein each "s" represents a phosphorothioate internucleoside linkage and each "o" represents a phosphodiester internucleoside linkage. Each cytosine nucleoside is a 5-methyl cytosine.

TABLE 46

4-10-6 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1373029 | CTATGTTTTCCAGTGCCCAT | 1335 | 1354 | 17126 | 17145 | 2190 |
| 1373030 | ACTCTATGTTTTCCAGTGCC | 1338 | 1357 | 17129 | 17148 | 2264 |
| 1373031 | GCTTATTATTCATGTTCTCC | N/A | N/A | 14367 | 14386 | 1939 |
| 1373032 | GTCATAATTTTCTTAGCTAC | N/A | N/A | 5638 | 5657 | 1914 |
| 1373033 | GCTTACTCGGCTTGTTCCAC | 723 | 742 | 16514 | 16533 | 351 |
| 1373034 | GTGTCATAATTTTCTTAGCT | N/A | N/A | 5640 | 5659 | 2302 |
| 1373035 | GCACACTGACCATTTTTAA | 2147 | 2166 | 17938 | 17957 | 584 |
| 1373036 | TCTATGTTTTCCAGTGCCCA | 1336 | 1355 | 17127 | 17146 | 1726 |
| 1373037 | CTCTATGTTTTCCAGTGCCC | 1337 | 1356 | 17128 | 17147 | 2191 |
| 1373038 | GTCAGTTTTTCCCCACATAT | N/A | N/A | 5715 | 5734 | 2304 |
| 1373039 | ACTTGTCAGTTTTTCCCCAC | N/A | N/A | 5719 | 5738 | 1301 |
| 1373040 | TGTCAGTTTTTCCCCACATA | N/A | N/A | 5716 | 5735 | 1070 |
| 1373078 | GCCACATATAGGGTCCTTTA | 1963 | 1982 | 17754 | 17773 | 66 |
| 1393327 | ACTGAATTTTCTCTCCCAGC | N/A | N/A | 14923 | 14942 | 2646 |
| 1411005 | CGTCCATTTTCTGTGCTTTT | N/A | N/A | 5806 | 5825 | 2647 |

The modified oligonucleotides in Table 47 and 48 below are 5-10-5 MOE gapmers with mixed PO/PS internucleoside linkages. The gapmers are 20 nucleosides in length and have a central gap segment that consists of ten 2'-β-D-deoxynucleosides, a 5' wing segment that consists of five 2'-MOE nucleosides, and a 3' wing segment that consists of five 2'-MOE nucleosides. The sugar motif of the gapmers is (from 5' to 3'): eeeeedddddddddddeeeee; wherein 'd' represents a 2'-β-D-deoxyribosyl sugar, and 'e' represents a 2'-MOE modified ribosyl sugar. The gapmers have an internucleoside linkage motif of (from 5' to 3'): sooossssssssss-sooss; wherein each "s" represents a phosphorothioate internucleoside linkage and each "o" represents a phosphodiester internucleoside linkage. Each cytosine nucleoside is a 5-methyl cytosine.

TABLE 47

5-10-5 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1355702 | CATAATGACTGCTCTGCAAA | N/A | N/A | 16204 | 16223 | 2651 |
| 1355704 | CCATAATGACTGCTCTGCAA | N/A | N/A | 16205 | 16224 | 2653 |
| 1355710 | ATTAGTGTGATCATGCACAT | N/A | N/A | 13535 | 13554 | 2655 |
| 1355711 | ACAGCCATGTTCAGTGTCAG | N/A | N/A | 6529 | 6548 | 2656 |
| 1355712 | TTGATTGTGATATTGACGCA | 964 | 983 | 16755 | 16774 | 2657 |
| 1355713 | CATGTTTTCACGATAGTAAC | 872 | 891 | 16663 | 16682 | 2658 |
| 1355714 | TATTCATGTTCTCCACGGGA | N/A | N/A | 14361 | 14380 | 2659 |
| 1355715 | AAAATGTTTGTCACTGGTTC | N/A | N/A | 5444 | 5463 | 2660 |
| 1355716 | AGAAGATAATCAAGGGTGCA | N/A | N/A | 7571 | 7590 | 2661 |
| 1355717 | ATCCTGATGTCAAAGTCCCA | N/A | N/A | 8742 | 8761 | 2662 |
| 1355718 | AGGTGCTGTCCAAGGCCATA | N/A | N/A | 13615 | 13634 | 2663 |
| 1355719 | TTAGTCTTGTCCTCAGTGCT | N/A | N/A | 15644 | 15663 | 2664 |
| 1355720 | CGTCCATTTTCTGTGCTTTT | N/A | N/A | 5806 | 5825 | 2647 |
| 1355721 | ACTGAATTTTCTCTCCCAGC | N/A | N/A | 14923 | 14942 | 2646 |
| 1355722 | TGGTTGCTGTACTCATCCAT | 925 | 944 | 16716 | 16735 | 2665 |
| 1355723 | GCATGTTTTCACGATAGTAA | 873 | 892 | 16664 | 16683 | 2666 |
| 1355724 | AACTGTGGGTCCATTTCATC | N/A | N/A | 5924 | 5943 | 2667 |
| 1355725 | TGACCATCTTATTCGGTGCT | N/A | N/A | 14820 | 14839 | 2668 |
| 1355726 | TCTATGGAATCTGTAGGTCA | N/A | N/A | 8234 | 8253 | 2669 |
| 1355727 | CAATTAGTGTGATCATGCAC | N/A | N/A | 13537 | 13556 | 2670 |
| 1355728 | TTTTCTGTGACATTTGGTGA | N/A | N/A | 6281 | 6300 | 2671 |
| 1355729 | GCTTCCATCACTTCTCACCT | N/A | N/A | 14803 | 14822 | 2672 |
| 1355730 | TTTCTGTGACATTTGGTGAC | N/A | N/A | 6280 | 6299 | 2673 |
| 1355731 | GACAGCCATGTTCAGTGTCA | N/A | N/A | 6530 | 6549 | 2674 |
| 1355732 | GGTTTCTGGGTCACAGCTTC | N/A | N/A | 5496 | 5515 | 2675 |
| 1355733 | AAGGTGCTGTCCAAGGCCAT | N/A | N/A | 13616 | 13635 | 2676 |
| 1355734 | TTCCTCTGTGCTTATTATTC | N/A | N/A | 14376 | 14395 | 2677 |
| 1355735 | GGTTGTTCTATAAATTCATC | N/A | N/A | 9441 | 9460 | 2678 |
| 1355736 | ACATTTATTTCATGTGCCAG | N/A | N/A | 14088 | 14107 | 2679 |
| 1355737 | CAAGGTGCTGTCCAAGGCCA | N/A | N/A | 13617 | 13636 | 2680 |
| 1355738 | CTGAAGTTAGTCTTGTCCTC | N/A | N/A | 15650 | 15669 | 2681 |
| 1355739 | GTTAGTCTTGTCCTCAGTGC | N/A | N/A | 15645 | 15664 | 2682 |
| 1355740 | CTCAAGGTGCTGTCCAAGGC | N/A | N/A | 13619 | 13638 | 2683 |
| 1355741 | TTAGTGTGATCATGCACATA | N/A | N/A | 13534 | 13553 | 2684 |
| 1355742 | CATTTATTTCATGTGCCAGC | N/A | N/A | 14087 | 14106 | 2685 |
| 1355743 | AAGTTAGTCTTGTCCTCAGT | N/A | N/A | 15647 | 15666 | 2686 |

TABLE 47-continued 5-10-5 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1355744 | CCCCACATATCACAGGCTCC | N/A | N/A | 5705 | 5724 | 2687 |
| 1355745 | CTTTCCTGATAGTTCACTGT | N/A | N/A | 8019 | 8038 | 2688 |
| 1355746 | AGATTCTTGTTCAGCACGAT | N/A | N/A | 12108 | 12127 | 2689 |
| 1355747 | CGGTGCATGTTTTCACGATA | 877 | 896 | 16668 | 16687 | 2690 |
| 1355748 | TTGACAGCCATGTTCAGTGT | N/A | N/A | 6532 | 6551 | 2691 |
| 1355749 | GTGCATGTTTTCACGATAGT | 875 | 894 | 16666 | 16685 | 2692 |
| 1355750 | TGCTTCCATCACTTCTCACC | N/A | N/A | 14804 | 14823 | 2693 |
| 1355751 | TTTCTAGAACTTGCAAGGAA | N/A | N/A | 12006 | 12025 | 2694 |
| 1355752 | CCTGATAGTTCACTGTTGGC | N/A | N/A | 8015 | 8034 | 2695 |
| 1355753 | TCTATTTGTGTCTCCTTGAA | N/A | N/A | 8153 | 8172 | 2696 |
| 1355754 | TTCTTAGCTACTGCCCTGGT | N/A | N/A | 5629 | 5648 | 2697 |
| 1355755 | TTTTTAGATTGTCTCCCTAT | 2270 | 2289 | 18061 | 18080 | 2698 |
| 1355756 | ATTTTTCCAACATGACCATC | N/A | N/A | 14832 | 14851 | 2699 |
| 1355757 | CACAACTGCAGCTCTCCTGT | 2097 | 2116 | 17888 | 17907 | 2700 |
| 1394116 | GCTCCTCAAACTGACAAGCC | N/A | N/A | 14590 | 14609 | 2701 |
| 1394117 | TTGCTCCTTTCCACTGGTGA | N/A | N/A | 4955 | 4974 | 2702 |
| 1394118 | GCACCTTCTCCATTCGCTGC | N/A | N/A | 14977 | 14996 | 2703 |
| 1394119 | GGTGCTTCCATCACTTCTCA | N/A | N/A | 14806 | 14825 | 2704 |
| 1394120 | GCTCATGGCACTTCCCAGCA | 815 | 834 | 16606 | 16625 | 2705 |
| 1394121 | GCCACCTTCACCCAATTTTA | N/A | N/A | 8306 | 8325 | 2706 |
| 1394122 | GAGCCTGCATCCCAAGAGCT | 1707 | 1726 | 17498 | 17517 | 2707 |
| 1394123 | GGGCACCATCCCCTCAGTCA | N/A | N/A | 15028 | 15047 | 2708 |
| 1394124 | GCTTGACCAGCATCTCAGGT | 1360 | 1379 | 17151 | 17170 | 2709 |
| 1394125 | CTGTAGCCATCACTGGGTTA | N/A | N/A | 6702 | 6721 | 2710 |
| 1394126 | CTGACAAGCCCATCCTGTCT | N/A | N/A | 14580 | 14599 | 2711 |
| 1394127 | TCCTCATCCCACTATCAGGA | 1175 | 1194 | 16966 | 16985 | 2712 |
| 1394128 | CCTCCATTCTATGAATGGAC | N/A | N/A | 5373 | 5392 | 2713 |
| 1394129 | CCCCCAATAACTCATACATA | N/A | N/A | 5418 | 5437 | 2714 |
| 1394130 | CGGTGCTTCCATCACTTCTC | N/A | N/A | 14807 | 14826 | 2715 |
| 1394131 | TCTCAGGTCTACTCTATGTT | 1348 | 1367 | 17139 | 17158 | 2716 |
| 1394132 | GTTCAGGCCTCCCACTGCTC | N/A | N/A | 14606 | 14625 | 2717 |
| 1394133 | CCAAGAGCTAAGAATCTCTA | 1696 | 1715 | 17487 | 17506 | 2718 |
| 1394134 | GTGAACAATAATCTATTGCT | N/A | N/A | 9473 | 9492 | 2719 |
| 1394135 | CTGTACTCATCCATGGGCCT | 919 | 938 | 16710 | 16729 | 2720 |
| 1394136 | GTGACTTTCAACCTTCCTAA | N/A | N/A | 6265 | 6284 | 2721 |

TABLE 47-continued 5-10-5 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1394137 | TCAGGTCTACTCTATGTTTT | 1346 | 1365 | 17137 | 17156 | 2722 |
| 1394138 | CTCAGGTCTACTCTATGTTT | 1347 | 1366 | 17138 | 17157 | 2723 |
| 1394139 | TTCCAGCTTCTTAATGCATC | N/A | N/A | 5479 | 5498 | 2724 |
| 1406230 | CTCCTTGAATTTCTTTCATC | N/A | N/A | 8142 | 8161 | 2725 |
| 1406232 | GCTTCTCAATTTTTCCAACA | N/A | N/A | 14840 | 14859 | 2726 |
| 1406236 | TCTTTCTAATTTTGTACACA | N/A | N/A | 7713 | 7732 | 2727 |
| 1406238 | GTTGTTCTATAAATTCATCT | N/A | N/A | 9440 | 9459 | 2728 |
| 1406243 | TCCTTGAATTTCTTTCATCA | N/A | N/A | 8141 | 8160 | 2729 |
| 1406250 | CCATTTTTAATTACATCAT | 2138 | 2157 | 17929 | 17948 | 2730 |
| 1406254 | TCTCCTTGAATTTCTTTCAT | N/A | N/A | 8143 | 8162 | 2731 |
| 1406261 | TCTGAGATTTGTTTTAGCCT | 1493 | 1512 | 17284 | 17303 | 2732 |
| 1406262 | CAATTGTTTTCTCTCTC | N/A | N/A | 15613 | 15632 | 2733 |
| 1406264 | TCTCAATTTTTGAGAAGTT | N/A | N/A | 13161 | 13180 | 2734 |
| 1406267 | TCTCAATTTTTCCAACATGA | N/A | N/A | 14837 | 14856 | 2735 |
| 1411013 | CCATTTTCTGTGCTTTTCCT | N/A | N/A | 5803 | 5822 | 2736 |
| 1411014 | TCCATTTTCTGTGCTTTTCC | N/A | N/A | 5804 | 5823 | 2737 |
| 1411015 | GTCCATTTTCTGTGCTTTTC | N/A | N/A | 5805 | 5824 | 2738 |
| 1411016 | ACGTCCATTTTCTGTGCTTT | N/A | N/A | 5807 | 5826 | 2739 |
| 1411017 | AACGTCCATTTTCTGTGCTT | N/A | N/A | 5808 | 5827 | 2740 |
| 1411018 | AAACGTCCATTTTCTGTGCT | N/A | N/A | 5809 | 5828 | 2741 |

TABLE 48

5-10-5 MOE gapmers with mixed PO/PS internucleoside linkages complementary to human PRNP

| Compound Number | Sequence (5' to 3') | SEQ ID NO: 4 Start Site | SEQ ID NO: 4 Stop Site | SEQ ID NO. |
|---|---|---|---|---|
| 1355700 | ATAATGACTGCCTCGGTCGT | 42 | 61 | 2649 |
| 1355701 | CCATAATGACTGCCTCGGTC | 44 | 63 | 2650 |
| 1355703 | TTCGCCATAATGACTGCCTC | 48 | 67 | 2652 |
| 1355705 | GTTCGCCATAATGACTGCCT | 49 | 68 | 2654 |

The modified oligonucleotides in the table below are 6-10-4 MOE gapmers with mixed PO/PS internucleoside linkages. The gapmers are 20 nucleosides in length and have a central gap segment that consists of ten 2'-β-D-deoxynucleosides, a 5' wing segment that consists of six 2'-MOE nucleosides, and a 3' wing segment that consists of four 2'-MOE nucleosides. The sugar motif of the gapmers is (from 5' to 3'): eeeeeedddddddddeeee; wherein 'd' represents a 2'-β-D-deoxyribosyl sugar, and 'e' represents a 2'-MOE modified ribosyl sugar. The gapmers have an internucleoside linkage motif of (from 5' to 3'): sooooossssssss-soss; wherein each "s" represents a phosphorothioate internucleoside linkage and each "o" represents a phosphodiester internucleoside linkage. Each cytosine nucleoside is a 5-methyl cytosine.

TABLE 49

6-10-4 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1335684 | TGGCACTTTCTTTTTATTTC | N/A | N/A | 8038 | 8057 | 1311 |
| 1335686 | GCACACTGACCATTTTTTAA | 2147 | 2166 | 17938 | 17957 | 584 |
| 1335687 | AAGGTTCGCCATAATGACTG | 422 | 441 | 16213 | 16232 | 38 |
| 1335688 | TGTCAGTTTTTCCCCACATA | N/A | N/A | 5716 | 5735 | 1070 |
| 1355706 | GCCACATATAGGGTCCTTTA | 1963 | 1982 | 17754 | 17773 | 66 |
| 1355707 | GTGACAATATTTACTCTTGT | 1813 | 1832 | 17604 | 17623 | 961 |
| 1355708 | GGTTACATAATGTTCATTTC | N/A | N/A | 5667 | 5686 | 1377 |
| 1355709 | TCGCCATAATGACTGCTCTG | 417 | 436 | 16208 | 16227 | 192 |
| 1373020 | CTATGTTTTCCAGTGCCCAT | 1335 | 1354 | 17126 | 17145 | 2190 |
| 1373021 | GTCATAATTTTCTTAGCTAC | N/A | N/A | 5638 | 5657 | 1914 |
| 1373022 | GCTTATTATTCATGTTCTCC | N/A | N/A | 14367 | 14386 | 1939 |
| 1373023 | GTGTCATAATTTTCTTAGCT | N/A | N/A | 5640 | 5659 | 2302 |
| 1373024 | GCTTACTCGGCTTGTTCCAC | 723 | 742 | 16514 | 16533 | 351 |
| 1373025 | ACTTGTCAGTTTTTCCCCAC | N/A | N/A | 5719 | 5738 | 1301 |
| 1373026 | ACTCTATGTTTTCCAGTGCC | 1338 | 1357 | 17129 | 17148 | 2264 |
| 1373027 | CTCTATGTTTTCCAGTGCCC | 1337 | 1356 | 17128 | 17147 | 2191 |
| 1373028 | GTCAGTTTTTCCCCACATAT | N/A | N/A | 5715 | 5734 | 2304 |
| 1393324 | ACTGAATTTTCTCTCCCAGC | N/A | N/A | 14923 | 14942 | 2646 |
| 1411004 | CGTCCATTTTCTGTGCTTTT | N/A | N/A | 5806 | 5825 | 2647 |
| 1423120 | CCATTTTCTGTGCTTTTCCT | N/A | N/A | 5803 | 5822 | 2736 |
| 1423121 | TCCATTTTCTGTGCTTTTCC | N/A | N/A | 5804 | 5823 | 2737 |
| 1423122 | GTCCATTTTCTGTGCTTTTC | N/A | N/A | 5805 | 5824 | 2738 |
| 1423123 | ACGTCCATTTTCTGTGCTTT | N/A | N/A | 5807 | 5826 | 2739 |
| 1423124 | AACGTCCATTTTCTGTGCTT | N/A | N/A | 5808 | 5827 | 2740 |
| 1423125 | AAACGTCCATTTTCTGTGCT | N/A | N/A | 5809 | 5828 | 2741 |

The modified oligonucleotides in the table below are 7-10-3 MOE gapmers with mixed PO/PS internucleoside linkages. The gapmers are 20 nucleosides in length and have a central gap segment that consists of ten 2'-β-D-deoxynucleosides, a 5' wing segment that consists of seven 2'-MOE nucleosides, and a 3' wing segment that consists of three 2'-MOE nucleosides. The sugar motif of the gapmers is (from 5' to 3'): eeeeeeedddddddddddeee; wherein 'd' represents a 2'-β-D-deoxyribosyl sugar, and 'e' represents a 2'-MOE modified ribosyl sugar. The gapmers have an internucleoside linkage motif of (from 5' to 3'): ssooooosssssssssos; wherein each "s" represents a phosphothioate internucleoside linkage and each "o" represents a phosphodiester internucleoside linkage. Each cytosine nucleoside is a 5-methyl cytosine.

TABLE 50

7-10-3 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1373045 | ACTCTATGTTTTCCAGTGCC | 1338 | 1357 | 17129 | 17148 | 2264 |
| 1373046 | CTATGTTTTCCAGTGCCCAT | 1335 | 1354 | 17126 | 17145 | 2190 |
| 1373047 | GTCAGTTTTTCCCCACATAT | N/A | N/A | 5715 | 5734 | 2304 |
| 1373048 | CTCTATGTTTTCCAGTGCCC | 1337 | 1356 | 17128 | 17147 | 2191 |
| 1393329 | ACTGAATTTTCTCTCCCAGC | N/A | N/A | 14923 | 14942 | 2646 |
| 1393330 | GCCACATATAGGGTCCTTTA | 1963 | 1982 | 17754 | 17773 | 66 |
| 1411006 | CGTCCATTTTCTGTGCTTTT | N/A | N/A | 5806 | 5825 | 2647 |

The modified oligonucleotides in the table below are 5-10-5 MOE gapmers with a 2'-OMe modified nucleoside at position 2 of the gap and mixed PO/PS internucleoside linkages. The gapmers are 20 nucleosides in length, wherein the 5' wing segment consists of five 2'-MOE nucleosides and the 3' wing segment consists of five 2'-MOE nucleosides. The gap is ten nucleosides in length, and has a nucleoside comprising a 2'-β-D-deoxyribosyl sugar moiety at positions 1, 3, 4, 5, 6, 7, 8, 9 and 10 of the gap (counting from the 5' end) and 2'-OMe nucleoside at position 2 of the gap (counting from the 5' end). The sugar motif of the mixed, altered gapmers is (from 5' to 3'): eeeeedydddddddeeeee; wherein 'd' represents a 2'-β-D-deoxyribosyl sugar, 'y' represents a 2'-O-methyl ribosyl sugar, 'k' represents a cEt sugar, and 'e' represents a 2'-MOE sugar. The gapmers have an internucleoside linkage motif of (from 5' to 3'): sooossssssssss-sooss; wherein "s" represents a phosphorothioate internucleoside linkage and "o" represents a phosphodiester internucleoside linkage. All cytosine residues are 5-methylcytosines.

TABLE 51

5-10-5 MOE gapmers having a 2'-OMe at position 2 of the gap with mixed PO/PS internucleoside linkages complementary to human PRNP

| Compound Number | SEQUENCE | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1418386 | CTCTATGTTTTCCAGTGCCC | 1337 | 1356 | 17128 | 17147 | 2191 |
| 1418387 | GTCAGTUTTTCCCCACATAT | N/A | N/A | 5715 | 5734 | 2648 |
| 1423126 | CGTCCAUTTTCTGTGCTTTT | N/A | N/A | 5806 | 5825 | 2744 |

The modified oligonucleotides in the table below are 5-10-5 mixed MOE/cEt gapmer with mixed PO/PS internucleoside linkages. The gapmers are 20 nucleosides in length, wherein the central gap segment consists of ten 2'-β-D-deoxynucleosides, a 5' wing segment that consists of five 2'-MOE nucleosides, and a 3' wing segment that consists of two cEt nucleosides and three 2'-MOE nucleosides. The sugar motif of the gapmers is (from 5' to 3'): eeeeedddddddddkkeee; wherein 'd' represents a 2'-Q-D-deoxyribosyl sugar, 'k' represents a cEt sugar, and 'c' represents a 2'-MOE modified ribosyl sugar. The gapmers have an internucleoside linkage motif of (from 5' to 3'): sooossssssssssooss; wherein "s" represents a phosphorothioate internucleoside linkage and "o" represents a phosphodiester internucleoside linkage. All cytosine residues are 5-methylcytosines.

TABLE 52

5-10-5 MOE/cEt mixed wing gapmers with mixed PO/PS internucleoside linkages complementary to human PRNP

| Compound Number | SEQUENCE | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1418416 | ACTCTATGTTTTCCAGTGCC | 1338 | 1357 | 17129 | 17148 | 2264 |
| 1418417 | GCCACATATAGGGTCCTTTA | 1963 | 1982 | 17754 | 17773 | 66 |
| 1418418 | GTCATAATTTTCTTAGCTAC | N/A | N/A | 5638 | 5657 | 1914 |
| 1418419 | GTGTCATAATTTTCTTAGCT | N/A | N/A | 5640 | 5659 | 2302 |
| 1418421 | GCTTATTATTCATGTTCTCC | N/A | N/A | 14367 | 14386 | 1939 |
| 1418426 | CGTCCATTTTCTGTGCTTTT | N/A | N/A | 5806 | 5825 | 2647 |

The modified oligonucleotides in the table below are 6-10-4 mixed MOE/cEt gapmer with mixed PO/PS internucleoside linkages. The gapmers are 20 nucleosides in length, wherein the central gap segment consists of ten 2'-β-D-deoxynucleosides, a 5' wing segment that consists of six 2'-MOE nucleosides, and a 3' wing segment that consists of two cEt nucleosides and two 2'-MOE nucleosides. The sugar motif of the gapmers is (from 5' to 3'): eeeeeedddddddddddkkee; wherein 'd' represents a 2'-D-D-deoxyribosyl sugar, 'k' represents a cEt sugar, and 'e' represents a 2'-MOE modified ribosyl sugar. The gapmers have an internucleoside linkage motif of (from 5' to 3'): sooooosssssssssssoss; wherein "s" represents a phosphorothioate internucleoside linkage and "o" represents a phosphodiester internucleoside linkage. All cytosine residues are 5-methylcytosines.

TABLE 53

6-10-4 MOE/cEt mixed wing gapmers with mixed PO/PS internucleoside linkages complementary to human PRNP

| Compound Number | SEQUENCE | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1418420 | GTCATAATTTTCTTAGCTAC | N/A | N/A | 5638 | 5657 | 1914 |
| 1418422 | GCCACATATAGGGTCCTTTA | 1963 | 1982 | 17754 | 17773 | 66 |
| 1418424 | GCTTATTATTCATGTTCTCC | N/A | N/A | 14367 | 14386 | 1939 |
| 1418425 | GTGTCATAATTTTCTTAGCT | N/A | N/A | 5640 | 5659 | 2302 |

The modified oligonucleotides in the table below are 6-10-4 mixed MOE gapmers with a 2'-OMe modified nucleoside at position 2 of the gap and mixed PO/PS internucleoside linkages. The gapmers are 20 nucleosides in length, wherein the 5' wing segment consists of six 2'-MOE nucleosides, and the 3' wing segment consists of four 2'-MOE nucleosides. The gap is ten nucleosides in length, and has a nucleoside comprising a 2'-β-D-deoxyribosyl sugar moiety at positions 1, 3, 4, 5, 6, 7, 8, 9 and 10 of the gap (counting from the 5' end) and a 2'-OMe nucleoside at position 2 of the gap (counting from the 5' end). The sugar motif of the mixed, altered gapmers is (from 5' to 3'): eeeeeedydddddddddeeee; wherein 'd' represents a 2'-β-D-deoxyribosyl sugar, 'y' represents a 2'-O-methyl ribosyl sugar, 'k' represents a cEt sugar, and 'e' represents a 2'-MOE sugar. The gapmers have an internucleoside linkage motif of (from 5' to 3'): sooooosssssssssssoss; wherein "s" represents a phosphorothioate internucleoside linkage and "o" represents a phosphodiester internucleoside linkage. All cytosine residues are 5-methylcytosines.

TABLE 54

6-10-4 MOE gapmers having a 2'-OMe at position 2 of the gap with mixed PO/PS internucleoside linkages complementary to human PRNP

| Compound Number | SEQUENCE | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1418389 | TGGCACTUTCTTTTTATTTC | N/A | N/A | 8038 | 8057 | 2743 |
| 1423127 | GGTTACAUAATGTTCATTTC | N/A | N/A | 5667 | 5686 | 2742 |

The modified oligonucleotides in the table below are 5-9-5 MOE gapmers with mixed PO/PS internucleoside linkages. The gapmers are 19 nucleosides in length and have a central gap segment that consists of nine 2'-β-D-deoxynucleosides, a 5' wing segment that consists of five 2'-MOE nucleosides, and a 3' wing segment that consists of five 2'-MOE nucleosides. The sugar motif of the gapmers is (from 5' to 3'): eeeeeddddddddddeeeee; wherein 'd' represents a 2'-R-D-deoxyribosyl sugar, and 'e' represents a 2'-MOE modified ribosyl sugar. The gapmers have an internucleoside linkage motif of (from 5' to 3'): soooossssssss-soos; wherein each "s" represents a phosphorothioate internucleoside linkage and each "o" represents a phosphodiester internucleoside linkage. Each cytosine nucleoside is a 5-methyl cytosine.

TABLE 55

5-9-5 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1373049 | GTCAGTTTTCCCCACATA | N/A | N/A | 5716 | 5734 | 2745 |
| 1373050 | GTGTCATAATTTTCTTAGC | N/A | N/A | 5641 | 5659 | 2764 |
| 1373051 | GCTTATTATTCATGTTCTC | N/A | N/A | 14368 | 14386 | 2765 |
| 1373052 | GCTTACTCGGCTTGTTCCA | 724 | 742 | 16515 | 16533 | 2766 |
| 1373053 | CTCTATGTTTTCCAGTGCC | 1338 | 1356 | 17129 | 17147 | 2746 |
| 1373054 | GCACACTGACCATTTTTTA | 2148 | 2166 | 17939 | 17957 | 2747 |
| 1373055 | ACTCTATGTTTTCCAGTGC | 1339 | 1357 | 17130 | 17148 | 2748 |
| 1373056 | TGTCAGTTTTCCCCACAT | N/A | N/A | 5717 | 5735 | 2749 |
| 1373057 | GTCATAATTTTCTTAGCTA | N/A | N/A | 5639 | 5657 | 2750 |
| 1373058 | CTATGTTTTCCAGTGCCCA | 1336 | 1354 | 17127 | 17145 | 2751 |
| 1373059 | TCTATGTTTTCCAGTGCCC | 1337 | 1355 | 17128 | 17146 | 2752 |
| 1393333 | CTGAATTTTCTCTCCCAGC | N/A | N/A | 14923 | 14941 | 2753 |
| 1393334 | CCACATATAGGGTCCTTTA | 1963 | 1981 | 17754 | 17772 | 2754 |
| 1393335 | GCCACATATAGGGTCCTTT | 1964 | 1982 | 17755 | 17773 | 2755 |
| 1393336 | ACTGAATTTTCTCTCCCAG | N/A | N/A | 14924 | 14942 | 2756 |

The modified oligonucleotides in the table below are 5-9-5 MOE gapmers with mixed PO/PS internucleoside linkages. The gapmers are 19 nucleosides in length and have a central gap segment that consists of nine 2'-β-D-deoxynucleosides, a 5' wing segment that consists of five 2'-MOE nucleosides, and a 3' wing segment that consists of five 2'-MOE nucleosides. The sugar motif of the gapmers is (from 5' to 3'): eeeeeddddddddddeeeee; wherein 'd' represents a 2'-β-D-deoxyribosyl sugar, and 'e' represents a 2'-MOE modified ribosyl sugar. The gapmers have an internucleoside linkage motif of (from 5' to 3'): soooossssssss-sooss; wherein each "s" represents a phosphorothioate internucleoside linkage and each "o" represents a phosphodiester internucleoside linkage. Each cytosine nucleoside is a 5-methyl cytosine.

TABLE 56

5-9-5 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1373060 | CTATGTTTTCCAGTGCCCA | 1336 | 1354 | 17127 | 17145 | 2751 |
| 1373061 | CTTATTATTCATGTTCTCC | N/A | N/A | 14367 | 14385 | 2757 |
| 1373062 | CTTACTCGGCTTGTTCCAC | 723 | 741 | 16514 | 16532 | 2758 |
| 1373063 | TGTCATAATTTTCTTAGCT | N/A | N/A | 5640 | 5658 | 2759 |
| 1373064 | TCTATGTTTTCCAGTGCCC | 1337 | 1355 | 17128 | 17146 | 2752 |
| 1373065 | TCATAATTTTCTTAGCTAC | N/A | N/A | 5638 | 5656 | 2760 |
| 1373066 | CACACTGACCATTTTTAA | 2147 | 2165 | 17938 | 17956 | 2761 |
| 1373067 | CTCTATGTTTTCCAGTGCC | 1338 | 1356 | 17129 | 17147 | 2746 |
| 1373068 | GTCAGTTTTTCCCCACATA | N/A | N/A | 5716 | 5734 | 2745 |
| 1373069 | TCAGTTTTTCCCCACATAT | N/A | N/A | 5715 | 5733 | 2762 |
| 1373070 | TATGTTTTCCAGTGCCCAT | 1335 | 1353 | 17126 | 17144 | 2763 |

The modified oligonucleotide in the table below is a 5-9-5 mixed MOE/cEt gapmer with mixed PO/PS internucleoside linkages. The gapmer is 19 nucleosides in length, wherein the central gap segment consists of nine 2'-β-D-deoxynucleosides, a 5' wing segment that consists of five 2'-MOE nucleosides, and a 3' wing segment that consists of two cEt nucleosides and three 2'-MOE nucleosides. The sugar motif of the gapmers is (from 5' to 3'): eeeeedddddddddkkeee; wherein 'd' represents a 2'-O-D-deoxyribosyl sugar, 'k' represents a cEt sugar, and 'e' represents a 2'-MOE modified ribosyl sugar. The gapmers have an internucleoside linkage motif of (from 5' to 3'):soooosssssssssssoos; wherein "s" represents a phosphorothioate internucleoside linkage and "o" represents a phosphodiester internucleoside linkage. All cytosine residues are 5-methylcytosines.

TABLE 57

5-9-5 MOE/cEt mixed wing gapmers with mixed PO/PS internucleoside linkages complementary to human PRNP

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1418423 | GTCATAATTTTCTTAGCTA | N/A | N/A | 5639 | 5657 | 2750 |

The modified oligonucleotides in the table below are 5-8-5 MOE gapmers with mixed PO/PS internucleoside linkages. The gapmers are 18 nucleosides in length and have a central gap segment that consists of eight 2'-β-D-deoxynucleosides, a 5' wing segment that consists of five 2'-MOE nucleosides, and a 3' wing segment that consists of five 2'-MOE nucleosides. The sugar motif of the gapmers is (from 5' to 3'): eeeeeddddddddeeeee; wherein 'd' represents a 2'-β-D-deoxyribosyl sugar, and 'e' represents a 2'-MOE modified ribosyl sugar. The gapmers have an internucleoside linkage motif of (from 5' to 3'): sooossssssssssooss; wherein each "s" represents a phosphorothioate internucleoside linkage and each "o" represents a phosphodiester internucleoside linkage. Each cytosine nucleoside is a 5-methyl cytosine.

TABLE 58

5-8-5 MOE gapmers with mixed PO/PS internucleoside linkages complementary to human PRNP

| Compound Number | Sequence (5' to 3') | SEQ ID NO: 1 Start Site | SEQ ID NO: 1 Stop Site | SEQ ID NO: 2 Start Site | SEQ ID NO: 2 Start Site | SEQ ID NO. |
|---|---|---|---|---|---|---|
| 1373071 | CAGTTTTTCCCCACATAT | N/A | N/A | 5715 | 5732 | 2767 |
| 1373072 | ACTCTATGTTTTCCAGTG | 1340 | 1357 | 17131 | 17148 | 2777 |
| 1373073 | TCTATGTTTTCCAGTGCC | 1338 | 1355 | 17129 | 17146 | 2778 |
| 1373074 | CTCTATGTTTTCCAGTGC | 1339 | 1356 | 17130 | 17147 | 2779 |
| 1373075 | CTATGTTTTCCAGTGCCC | 1337 | 1354 | 17128 | 17145 | 2768 |
| 1373076 | GTCAGTTTTTCCCCACAT | N/A | N/A | 5717 | 5734 | 2769 |
| 1373077 | TCAGTTTTTCCCCACATA | N/A | N/A | 5716 | 5733 | 2770 |
| 1393337 | CCACATATAGGGTCCTTT | 1964 | 1981 | 17755 | 17772 | 2771 |
| 1393338 | CACATATAGGGTCCTTTA | 1963 | 1980 | 17754 | 17771 | 2772 |
| 1393339 | ACTGAATTTTCTCTCCCA | N/A | N/A | 14925 | 14942 | 2773 |
| 1393340 | TGAATTTTCTCTCCCAGC | N/A | N/A | 14923 | 14940 | 2774 |
| 1393341 | CTGAATTTTCTCTCCCAG | N/A | N/A | 14924 | 14941 | 2775 |
| 1393342 | GCCACATATAGGGTCCTT | 1965 | 1982 | 17756 | 17773 | 2776 |

The modified oligonucleotide in the table below is a 5-8-5 MOE gapmer with a 2'-OMe modified nucleoside at position 2 of the gap and mixed PO/PS internucleoside linkages. The gapmers are 18 nucleosides in length, wherein the 5' wing segment consists of five 2'-MOE nucleosides and the 3' wing segment consists of five 2'-MOE nucleosides. The gap is eight nucleosides in length, and has a nucleoside comprising a 2'-D-D-deoxyribosyl sugar moiety at positions 1, 3, 4, 5, 6, 7, and 8 of the gap (counting from the 5' end) and 2'-OMe nucleoside at position 2 of the gap (counting from the 5' end). The sugar motif of the gapmer is (from 5' to 3'): eeeeedyddddddeeeee; wherein 'd' represents a 2'-β-D-deoxyribosyl sugar, 'y' represents a 2'-O-methyl ribosyl sugar, and 'e' represents a 2'-MOE sugar. The gapmers have an internucleoside linkage motif of (from 5' to 3'): sooosssssssssooss; wherein "s" represents a phosphorothioate internucleoside linkage and "o" represents a phosphodiester internucleoside linkage. All cytosine residues are 5-methylcytosines.

TABLE 59

5-8-5 MOE gapmers having a 2'-OMe at position 2 of the gap with mixed PO/PS internucleoside linkages complementary to human PRNP

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1418388 | CTATGTUTTCCAGTGCCC | 1337 | 1354 | 17128 | 17145 | 2780 |

The modified oligonucleotides in the table below are 4-8-5 mixed MOE/cEt gapmers with mixed PO/PS internucleoside linkages. The gapmers are 17 nucleosides in length, wherein the central gap segment consists of eight 2'-β-D-deoxynucleosides, a 5' wing segment that consists of four 2'-MOE nucleosides, and a 3' wing segment that consists of two cEt nucleosides and three 2'-MOE nucleosides. The sugar motif of the gapmers is (from 5' to 3'): eeeedddddddddkkeee; wherein 'd' represents a 2'-β-D-deoxyribosyl sugar, 'k' represents a cEt sugar, and 'e' represents a 2'-MOE modified ribosyl sugar. The gapmers have an internucleoside linkage motif of (from 5' to 3'): soosssssssssooss; wherein "s" represents a phosphorothioate internucleoside linkage and "o" represents a phosphodiester internucleoside linkage. All cytosine residues are 5-methylcytosines.

TABLE 60

4-8-5 MOE/cEt mixed wing gapmers with mixed PO/PS internucleoside linkages complementary to human PRNP

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1418390 | CTATGTTTTCCAGTGCC | 1338 | 1354 | 17129 | 17145 | 2802 |
| 1418391 | ACTCTATGTTTTCCAGT | 1341 | 1357 | 17132 | 17148 | 2781 |
| 1418392 | TCTATGTTTTCCAGTGC | 1339 | 1355 | 17130 | 17146 | 2782 |
| 1418393 | CTCTATGTTTTCCAGTG | 1340 | 1356 | 17131 | 17147 | 2783 |
| 1418394 | ACATATAGGGTCCTTTA | 1963 | 1979 | 17754 | 17770 | 2784 |
| 1418395 | GCCACATATAGGGTCCT | 1966 | 1982 | 17757 | 17773 | 2785 |
| 1418396 | CACATATAGGGTCCTTT | 1964 | 1980 | 17755 | 17771 | 2786 |
| 1418397 | CCACATATAGGGTCCTT | 1965 | 1981 | 17756 | 17772 | 2787 |
| 1418398 | ATAATTTTCTTAGCTAC | N/A | N/A | 5638 | 5654 | 2788 |
| 1418399 | GTCATAATTTTCTTAGC | N/A | N/A | 5641 | 5657 | 2789 |
| 1418400 | CATAATTTTCTTAGCTA | N/A | N/A | 5639 | 5655 | 2790 |
| 1418401 | TCATAATTTTCTTAGCT | N/A | N/A | 5640 | 5656 | 2791 |
| 1418402 | GTGTCATAATTTTCTTA | N/A | N/A | 5643 | 5659 | 2792 |
| 1418403 | TGTCATAATTTTCTTAG | N/A | N/A | 5642 | 5658 | 2793 |
| 1418404 | TATTATTCATGTTCTCC | N/A | N/A | 14367 | 14383 | 2794 |
| 1418405 | GCTTATTATTCATGTTC | N/A | N/A | 14370 | 14386 | 2795 |
| 1418406 | TTATTATTCATGTTCTC | N/A | N/A | 14368 | 14384 | 2796 |
| 1418407 | CTTATTATTCATGTTCT | N/A | N/A | 14369 | 14385 | 2797 |
| 1418412 | CCATTTTCTGTGCTTTT | N/A | N/A | 5806 | 5822 | 2798 |
| 1418413 | CGTCCATTTTCTGTGCT | N/A | N/A | 5809 | 5825 | 2799 |
| 1418414 | TCCATTTTCTGTGCTTT | N/A | N/A | 5807 | 5823 | 2800 |
| 1418415 | GTCCATTTTCTGTGCTT | N/A | N/A | 5808 | 5824 | 2801 |

The modified oligonucleotides in the table below are 4-8-4 mixed MOE/cEt gapmers with mixed PO/PS internucleoside linkages. The gapmers are 17 nucleotides in length, wherein the central gap segment consists of eight 2'-β-D-deoxynucleosides, a 5' wing segment that consists of four 2'-MOE nucleosides, and a 3' wing segment that consists of two cEt nucleosides and two 2'-MOE nucleosides. The sugar motif of the gapmers is (from 5' to 3'): eeeedddddddddkkee; wherein 'd' represents a 2'-D-D-deoxyribosyl sugar, 'k' represents a cEt sugar, and 'e' represents a 2'-MOE modified ribosyl sugar. The gapmers have an internucleoside linkage motif of (from 5' to 3'): soossssssssssoos; wherein "s" represents a phosphorothioate internucleoside linkage and "o" represents a phosphodiester internucleoside linkage. All cytosine residues are 5-methylcytosines.

TABLE 61

4-8-4 MOE/cEt mixed wing gapmers with mixed PO/PS internucleoside linkages complementary to human PRNP

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1418408 | ATAATTTTCTTAGCTA | N/A | N/A | 5639 | 5654 | 2806 |
| 1418409 | GTCATAATTTTCTTAG | N/A | N/A | 5642 | 5657 | 2803 |

TABLE 61-continued 4-8-4 MOE/cEt mixed wing gapmers with mixed PO/PS internucleoside linkages complementary to human PRNP

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1418410 | CATAATTTTCTTAGCT | N/A | N/A | 5640 | 5655 | 2804 |
| 1418411 | TCATAATTTTCTTAGC | N/A | N/A | 5641 | 5656 | 2805 |

Example 5: Activity of Modified Oligonucleotides Complementary to Human PRNP in Transgenic Mice Modified oligonucleotides described above were tested in human PRNP knock-in mouse model. Humanization of PRNP gene was done via CRISPR/Cas-9-mediated gene editing, allowing for generation of a model with constitutive expression of human PRNP gene. Targeting strategy was based on NCBI transcripts NM_011170.3 (mouse) and NM_000311.1 (human). Mouse genomic sequence from exon 1 (5' untranslated region, UTR) to exon 3 (3' UTR) were replaced with its human counterpart. A plasmid allowing expression of Cas9 mRNA and specific gRNA, plasmid containing the puromycin resistance cassette, and a plasmid containing the homology regions of the mouse PRNP gene and the replaced human region were co-transfected into the Taconic Biosciences C57BL/6N Tac ES cell line. Homologous recombination clones were isolated using positive puromycin selection, and humanized allele was obtained after Cas9-mediated gene editing. Line C57BL/6NTac-Pmp<em5804_E-D05(PRNP) was used in these experiments. Human PRNP RNA expression is found in the brain and spinal cord.

Treatment

The PRNP knock-in mice were divided into groups of 2-3 mice each. Each mouse received a single ICV bolus of 300 µg of a modified oligonucleotide described above. A group of 2-4 mice received PBS as a negative control within each study. Also tested in one study were comparator compounds 169746, 169750, 169753, and 169764, described herein above and in WO2010/019270.

RNA Analysis

Two weeks post treatment, mice were sacrificed and RNA was extracted from cortical brain tissue and spinal cord for RTPCR analysis to measure amount of PRNP RNA using human primer probe sets RTS42354 (described herein above) and primer probe set RTS42356 (forward sequence GGTGGTGTCTCACTCTTTCTTC, designated herein as SEQ ID NO: 12; reverse sequence CCAG-CATCTCAGGTCTACTCTA, designated herein as SEQ ID NO: 13; probe sequence AATACCCTTGGCACT-GATGGGCA, designated herein as SEQ ID NO: 14). Results are presented as percent human PRNP RNA relative to PBS control, normalized to mouse cyclophilin A. Each study is represented in a separate table. Cyclophilin A was amplified using primer probe set m_cyclo24 (forward sequence TCGCCGCTTGCTGCA, designated herein as SEQ ID NO: 18; reverse sequence ATCGGCCGT-GATGTCGA, designated herein as SEQ ID NO: 19; probe sequence CCATGGTCAACCCCACCGTGTTC, designated herein as SEQ ID NO: 20). In some cases, RTPCR value is not defined for a certain sample, and is labeled N.D. (Not Defined). The values marked with a (*) symbol indicate that the modified oligonucleotide is complementary to the amplicon region of the primer probe set. Additional assays may be used to measure the potency and efficacy of the modified oligonucleotides complementary to the amplicon region, including testing with a second primer probe set.

As shown in the table below, treatment with modified oligonucleotides resulted in reduction of PRNP RNA in comparison to the PBS control.

TABLE 62

Reduction of human PRNP RNA in knock-in mice

| | PRNP RNA (% control) | | | |
|---|---|---|---|---|
| Compound | RTS42354 | | RTS42356 | |
| Number | Cortex | Spinal Cord | Cortex | Spinal Cord |
| PBS | 100 | 100 | 100 | 100 |
| 169746 | 67 | 52 | 72 | 46 |
| 169750 | 73‡ | 61‡ | 78‡ | 52‡ |
| 169753 | 37 | 32 | 37 | 29 |
| 169764 | 77 | 61 | 80 | 57 |
| 1201071 | 80 | 67 | 83 | 54 |
| 1201142 | 29‡ | 30‡ | 35‡ | 28‡ |
| 1238171 | 62* | 71* | 83 | 74 |
| 1238195 | 90 | 67 | 87 | 64 |
| 1238240 | 63 | 46 | 8* | 6* |
| 1238320 | 83 | 71 | 93 | 60 |
| 1238321 | 73 | 73 | 82 | 69 |
| 1239027 | 28 | 25 | 29 | 20 |
| 1239250 | 32 | 20 | 32 | 16 |
| 1239696 | 88 | 73 | 90 | 65 |
| 1270230 | 48 | 44 | 33* | 21* |
| 1270231 | 15 | 22 | 13* | 10* |
| 1270232 | 29 | 29 | 28* | 20* |
| 1270293 | 64 | 64 | 63 | 54 |
| 1270406 | 16 | 19 | 18 | 12 |
| 1270457 | 42 | 26 | 46 | 22 |
| 1270458 | 44 | 36 | 47 | 30 |
| 1335684 | 30 | 28 | 30 | 20 |
| 1335686 | 47 | 37 | 46 | 27 |
| 1335688 | 34 | 22 | 35 | 16 |

‡Notes value is based on a single animal and is not an average.

TABLE 63

Reduction of human PRNP RNA in knock-in mice

| | PRNP RNA (% control) | | | |
|---|---|---|---|---|
| Compound | RTS42354 | | RTS42356 | |
| Number | Cortex | Spinal Cord | Cortex | Spinal Cord |
| PBS | 100 | 100 | 100 | 100 |
| 1200973 | 12* | 10* | 94 | 73 |
| 1201005 | 52 | 30 | 53 | 33 |
| 1201142 | 61 | 16 | 43 | 18 |
| 1238167 | 44* | 6* | 104 | 74 |
| 1238168 | 52* | 8* | 103 | 74 |

TABLE 63-continued

Reduction of human PRNP RNA in knock-in mice

| | PRNP RNA (% control) | | | |
|---|---|---|---|---|
| Compound | RTS42354 | | RTS42356 | |
| Number | Cortex | Spinal Cord | Cortex | Spinal Cord |
| 1238169 | 42* | 6* | 88 | 52 |
| 1238170 | 39* | 6* | 76 | 51 |
| 1238322 | 61 | 21 | 63 | 30 |
| 1238325 | 84 | 30 | 70 | 35 |
| 1238490 | 60 | 26 | 43 | 28 |
| 1238498 | 97 | 48 | 68 | 54 |
| 1238507 | 104 | 48 | 74 | 50 |
| 1238517 | 104 | 45 | 67 | 44 |
| 1238812 | 72 | 40 | 48 | 35 |
| 1238863 | 119 | 46 | 76 | 41 |
| 1238987 | 88 | 35 | 57 | 34 |
| 1239009 | 68 | 34 | 44 | 31 |
| 1239027 | 49 | 24 | 33 | 23 |
| 1239052 | 94 | 40 | 60 | 38 |
| 1239234 | 70 | 29 | 44 | 28 |
| 1239250 | 54 | 19 | 36 | 18 |
| 1239544 | 80 | 29 | 55 | 27 |
| 1201143 | 123 | 40 | 83 | 37 |
| 1201154 | 100 | 36 | 66 | 34 |
| 1201157 | 111 | 49 | 74 | 42 |
| 1201255 | 142 | 66 | 93 | 59 |
| 1238580 | 80 | 48 | 53 | 47 |
| 1238582 | 130 | 67 | 83 | 65 |
| 1238600 | 123 | 57 | 80 | 56 |
| 1238632 | 115 | 60 | 74 | 57 |

TABLE 64

Reduction of human PRNP RNA in knock-in mice

| | PRNP RNA (% control) | | | |
|---|---|---|---|---|
| Compound | RTS42354 | | RTS42356 | |
| Number | Cortex | Spinal Cord | Cortex | Spinal Cord |
| PBS | 100 | 100 | 100 | 100 |
| 1201142 | 44 | 29 | 44 | 32 |
| 1200974 | 37* | 46* | 96 | 96 |
| 1200975 | 43* | 21* | 101 | 85 |
| 1200976 | 67* | 47* | 102 | 86 |
| 1200978 | 33* | 26* | 105 | 104 |
| 1201143 | 77 | 38 | 73 | 41 |
| 1238339 | 81 | 50 | 78 | 53 |
| 1238404 | 86 | 49 | 80 | 57 |
| 1238410 | 56 | 38 | 55 | 43 |
| 1238489 | 93 | 70 | 89 | 73 |
| 1238491 | 65 | 49 | 58 | 47 |
| 1238492 | 66 | 53 | 61 | 53 |
| 1238500 | 69 | 44 | 61 | 45 |
| 1238501 | 59 | 49 | 53 | 50 |
| 1238600 | 83 | 67 | 78 | 70 |
| 1238814 | 83 | 51 | 76 | 53 |
| 1238837 | 64 | 48 | 60 | 50 |
| 1238947 | 80 | 41 | 80 | 49 |
| 1238990 | 86 | 48 | 84 | 54 |
| 1238996 | 64 | 42 | 60 | 46 |
| 1239010 | 76 | 37 | 71 | 39 |
| 1239024 | 93 | 72 | 91 | 77 |
| 1239025 | 89 | 52 | 79 | 54 |
| 1239026 | 91 | 67 | 84 | 64 |
| 1239028 | 59 | 38 | 58 | 40 |
| 1239029 | 65 | 40 | 64 | 42 |
| 1239030 | 47 | 34 | 43 | 37 |
| 1239031 | 68 | 44 | 66 | 49 |
| 1239045 | 80 | 51 | 79 | 55 |
| 1239062 | 97 | 68 | 97 | 79 |
| 1239063 | 88 | 39 | 87 | 43 |
| 1239293 | 91 | 40 | 90 | 42 |

TABLE 64-continued

Reduction of human PRNP RNA in knock-in mice

| | PRNP RNA (% control) | | | |
|---|---|---|---|---|
| Compound | RTS42354 | | RTS42356 | |
| Number | Cortex | Spinal Cord | Cortex | Spinal Cord |
| 1239448 | 13 | 180 | 8 | 111 |
| 1270213 | 43* | 66* | 92 | 98 |
| 1270228 | 65 | 39 | 43* | 32* |
| 1270229 | 39 | 27 | 32* | 22* |
| 1270230 | 32 | 39 | 18* | 26* |
| 1270231 | 42 | 21 | 27* | 16* |
| 1270232 | 50 | 22 | 35* | 18* |
| 1270233 | 70 | 46 | 56* | 47* |
| 1270301 | 78 | 58 | 70 | 60 |
| 1270302 | 81 | 61 | 73 | 60 |
| 1270303 | 97 | 58 | 90 | 60 |
| 1270405 | 72 | 49 | 64 | 53 |
| 1270406 | 25 | 19 | 22 | 20 |
| 1270457 | 37 | 27 | 35 | 30 |
| 1270458 | 40 | 33 | 36 | 34 |
| 1335684 | 32 | 31 | 25 | 30 |
| 1335686 | 39 | 36 | 32 | 34 |
| 1335687 | 44* | 58* | 83 | 79 |
| 1335688 | 34 | 19 | 31 | 18 |

TABLE 65

Reduction of human PRNP RNA in knock-in mice

| | PRNP RNA (% control) | | | |
|---|---|---|---|---|
| Compound | RTS42354 | | RTS42356 | |
| Number | Cortex | Spinal Cord | Cortex | Spinal Cord |
| PBS | 100 | 100 | 100 | 100 |
| 1201142 | 31 | 33 | 29 | 31 |
| 1201144 | 114 | 80 | 102 | 66 |
| 1238319 | 91 | 79 | 97 | 80 |
| 1238326 | 88 | 70 | 84 | 56 |
| 1238328 | ‡93 | ‡86 | ‡85 | ‡63 |
| 1238335 | 80 | 61 | 69 | 57 |
| 1238397 | 110 | 100 | 97 | 90 |
| 1238398 | 104 | 79 | 96 | 72 |
| 1238994 | 41 | 32 | 39 | 29 |
| 1238998 | 87 | 86 | 80 | 77 |
| 1239003 | 98 | 85 | 94 | 76 |
| 1239004 | 62 | 47 | 95 | 91 |
| 1239005 | 57 | 72 | 88 | 81 |
| 1239007 | 92 | 75 | 86 | 66 |
| 1239008 | 62 | 67 | 61 | 59 |
| 1239012 | 100 | 82 | 92 | 69 |
| 1239013 | 96 | 97 | 91 | 86 |
| 1239015 | 73 | 69 | 62 | 61 |
| 1270212 | 26* | 47* | 96 | 88 |
| 1270265 | 63 | 57 | 60 | 50 |
| 1270279 | 108 | 92 | 93 | 85 |
| 1270280 | 77 | 80 | 71 | 71 |
| 1270281 | 56 | 38 | 55 | 41 |
| 1270282 | 83 | 52 | 75 | 46 |
| 1270400 | 41 | 33 | 38 | 27 |
| 1270401 | 106 | 100 | 89 | 79 |
| 1270402 | 107 | 82 | 93 | 67 |
| 1270542 | 100 | 100 | 83 | 82 |
| 1270551 | 115 | 105 | 105 | 88 |
| 1270584 | 100 | 91 | 85 | 76 |
| 1270616 | 120 | 108 | 105 | 88 |
| 1355700 | 111* | 112* | 108 | 98 |
| 1355701 | 36* | 54* | 103 | 96 |
| 1355702 | 113* | 103* | 105 | 93 |
| 1355703 | 43* | 64* | 89 | 87 |
| 1355704 | 70* | 81* | 98 | 96 |
| 1355705 | 67* | 83* | 96 | 99 |
| 1355706 | 32 | 30 | 29 | 25 |

TABLE 65-continued

Reduction of human PRNP RNA in knock-in mice

| Compound | PRNP RNA (% control) | | | |
|---|---|---|---|---|
| | RTS42354 | | RTS42356 | |
| Number | Cortex | Spinal Cord | Cortex | Spinal Cord |
| 1355707 | 70 | 55 | 60 | 48 |
| 1355708 | 40 | 40 | 37 | 35 |
| 1355709 | 16* | 17* | 78 | 70 |

‡Notes value is based on a single animal and is not an average.

TABLE 66

Reduction of human PRNP RNA in knock-in mice

| Compound | PRNP RNA (% control) | | | |
|---|---|---|---|---|
| | RTS42354 | | RTS42356 | |
| Number | Cortex | Spinal Cord | Cortex | Spinal Cord |
| PBS | 100 | 100 | 100 | 100 |
| 1201142 | 37 | 69 | 40 | 98 |
| 1201004 | 90 | 61 | 90 | 116 |
| 1201006 | 68 | 58 | 70 | 123 |
| 1201007 | 76 | 60 | 76 | 91 |
| 1201141 | 62 | 55 | 64 | 92 |
| 1238202 | 91 | 82 | 92 | 109 |
| 1239543 | 68 | 74 | 69 | 92 |
| 1239545 | 81 | 81 | 79 | 88 |
| 1239546 | 90 | 87 | 88 | 71 |
| 1239547 | 91 | 113 | 93 | 86 |
| 1373020 | 60 | 65 | 18* | 25* |
| 1373021 | 31 | 32 | 26 | 35 |
| 1373022 | 36 | 43 | 37 | 40 |
| 1373023 | 28 | 28 | 28 | 35 |
| 1373024 | 62 | 59 | 60 | 50 |
| 1373025 | 57 | 45 | 59 | 43 |
| 1373026 | 57 | 48 | 44* | 28* |
| 1373027 | 53 | 56 | 31* | 21* |
| 1373028 | 72 | 61 | 68 | 56 |
| 1373029 | 73 | 68 | 61* | 35* |
| 1373030 | 73 | 60 | 66* | 40* |
| 1373031 | 68 | 63 | 56 | 44 |
| 1373032 | 59 | 43 | 57 | 50 |
| 1373033 | 83 | 55 | 82 | 70 |
| 1373034 | 56 | 48 | 57 | 79 |
| 1373035 | 64 | 48 | 64 | 81 |
| 1373036 | 41 | 33 | 40* | 45* |
| 1373037 | 35 | 37 | 32* | 53* |
| 1373038 | 41 | 31 | 41 | 51 |
| 1373039 | 51 | 51 | 50 | 70 |
| 1373040 | 34 | 34 | 35 | 56 |
| 1373041 | 32 | 44 | 29 | 51 |
| 1373042 | 57 | 59 | 56* | 41* |
| 1373043 | 39 | 48 | 37* | 32* |
| 1373044 | 36 | 42 | 26* | 28* |
| 1373045 | 49 | 59 | 31* | 29* |
| 1373046 | 52 | 57 | 15* | 16* |
| 1373047 | 56 | 58 | 44 | 42 |
| 1373048 | 46 | 67 | 21* | 22* |
| 1373049 | 59 | 48 | 51 | 40 |
| 1373050 | 65 | 66 | 44 | 44 |
| 1373051 | 59 | 72 | 57 | 61 |
| 1373052 | 59 | 68 | 48 | 56 |
| 1373053 | 44 | 50 | 35* | 38* |
| 1373054 | 53 | 64 | 46 | 59 |
| 1373055 | 75 | 78 | 668 | 518 |
| 1373056 | 39 | 33 | 43 | 32 |
| 1373057 | 41 | 25 | 29 | 24 |
| 1373058 | 45 | 42 | 24* | 19* |
| 1373059 | 31 | 22 | 20* | 15* |
| 1373060 | 42 | 43 | 24* | 19* |
| 1373061 | 46 | 64 | 45 | 59 |
| 1373062 | 62 | 89 | 90 | 85 |

TABLE 66-continued

Reduction of human PRNP RNA in knock-in mice

| Compound | PRNP RNA (% control) | | | |
|---|---|---|---|---|
| | RTS42354 | | RTS42356 | |
| Number | Cortex | Spinal Cord | Cortex | Spinal Cord |
| 1373063 | 43 | 52 | 74 | 43 |
| 1373064 | 71 | 92 | 89* | 81* |
| 1373065 | 93 | 93 | 94 | 83 |
| 1373066 | 95 | 94 | 77 | 82 |
| 1373067 | 64 | 34 | 46* | 20* |
| 1373068 | 53 | 36 | 55 | 31 |
| 1373069 | 57 | 51 | 66 | 49 |
| 1373070 | 66 | 55 | 62* | 56* |
| 1373071 | 70 | 70 | 73 | 67 |
| 1373072 | 62 | 58 | 55* | 52* |
| 1373073 | 51 | 46 | 45* | 40* |
| 1373074 | 63 | 47 | 56* | 41* |
| 1373075 | 31 | 27 | 25* | 14* |
| 1373076 | 30 | 23 | 29 | 16 |
| 1373077 | 80 | 71 | 76 | 66 |
| 1373078 | 54 | 36 | 53 | 35 |

TABLE 67

Reduction of human PRNP RNA in knock-in mice

| Compound | PRNP RNA (% control) | | | |
|---|---|---|---|---|
| | RTS42354 | | RTS42356 | |
| Number | Cortex | Spinal Cord | Cortex | Spinal Cord |
| PBS | 100 | 100 | 100 | 100 |
| 1201263 | 62 | 45 | 64 | 44 |
| 1201324 | 86 | 63 | 92 | 66 |
| 1238739 | 74 | 45 | 74 | 47 |
| 1238741 | 91 | 56 | 93 | 60 |
| 1238816 | 72 | 48 | 74 | 52 |
| 1238818 | 97 | 63 | 97 | 71 |
| 1238867 | 87 | 68 | 91 | 69 |
| 1238940 | 87 | 48 | 88 | 50 |
| 1239047 | 91 | 63 | 96 | 66 |
| 1239048 | 84 | 67 | 91 | 70 |
| 1239073 | 66 | 41 | 67 | 43 |
| 1239079 | 71 | 50 | 73 | 52 |
| 1239086 | 82 | 60 | 85 | 64 |
| 1239138 | 77 | 39 | 76 | 41 |
| 1239159 | 101 | 64 | 100 | 62 |
| 1239185 | 92 | 58 | 99 | 60 |
| 1239235 | 56 | 32 | 60 | 35 |
| 1239272 | 79 | 45 | 86 | 49 |
| 1239346 | 61 | 40 | 62 | 44 |
| 1239347 | 71 | 45 | 74 | 48 |
| 1239370 | 87 | 60 | 91 | 65 |
| 1239419 | 107 | 80 | 111 | 83 |
| 1239452 | 71 | 44 | 72 | 46 |
| 1239460 | 84 | 64 | 80 | 61 |
| 1239514 | 101 | 75 | 98 | 74 |
| 1239541 | 80 | 50 | 84 | 51 |
| 1239547 | 81 | 63 | 82 | 65 |
| 1239598 | 94 | 63 | 93 | 64 |
| 1270345 | 79 | 56 | 82 | 60 |
| 1270411 | 74 | 47 | 75 | 52 |
| 1270412 | 75 | 38 | 81 | 41 |

TABLE 68

Reduction of human PRNP RNA in knock-in mice

| Compound Number | PRNP RNA (% control) | | | |
|---|---|---|---|---|
| | RTS42354 | | RTS42356 | |
| | Cortex | Spinal Cord | Cortex | Spinal Cord |
| PBS | 100 | 100 | 100 | 100 |
| 1355710 | 105 | 89 | 97 | 98 |
| 1355711 | 93 | 57 | 80 | 72 |
| 1355712 | 122 | 79 | 91 | 96 |
| 1355713 | 114 | 86 | 97 | 100 |
| 1355714 | 116 | 70 | 94 | 87 |
| 1355715 | 102 | 54 | 75 | 63 |
| 1355716 | 117 | 79 | 83 | 93 |
| 1355717 | 108 | 63 | 68 | 75 |
| 1355718 | 150 | 74 | 100 | 95 |
| 1355719 | 185 | 68 | 114 | 86 |
| 1355720 | 51 | 32 | 26 | 33 |
| 1355721 | 119 | 65 | 63 | 67 |
| 1355722 | 119 | 67 | 64 | 70 |
| 1355723 | 130 | 72 | 73 | 78 |
| 1355724 | 120 | 60 | 68 | 65 |
| 1355725 | 116 | 56 | 64 | 58 |
| 1355726 | 128 | 63 | 85 | 68 |
| 1355727 | 186 | 83 | 112 | 89 |
| 1355728 | 74 | 49 | 60 | 53 |
| 1355729 | 171 | 73 | 117 | 85 |
| 1355730 | 179 | 82 | 115 | 94 |
| 1355731 | 149 | 66 | 104 | 84 |
| 1355732 | 79 | 62 | 83 | 47 |
| 1355733 | 92 | 84 | 92 | 87 |
| 1355734 | 62 | 54 | 59 | 58 |
| 1355735 | 55 | 51 | 51 | 58 |
| 1355736 | 82 | 66 | 82 | 71 |
| 1355737 | 86 | 71 | 89 | 86 |
| 1355738 | 95 | 53 | 77 | 64 |
| 1355739 | 92 | 58 | 74 | 74 |
| 1355740 | 98 | 67 | 81 | 81 |
| 1355741 | 119 | 85 | 91 | 97 |
| 1355742 | 105 | 66 | 75 | 77 |
| 1355743 | 117 | 72 | 88 | 86 |
| 1355744 | 64 | 43 | 44 | 57 |
| 1355745 | 130 | 69 | 93 | 92 |
| 1355746 | 110 | 79 | 67 | 83 |
| 1355747 | 117 | 69 | 63 | 70 |
| 1355748 | 128 | 80 | 71 | 87 |
| 1355749 | 135 | 69 | 78 | 78 |
| 1355750 | 146 | 77 | 90 | 83 |
| 1355751 | 146 | 81 | 92 | 91 |
| 1355752 | 109 | 50 | 67 | 53 |
| 1355753 | 146 | 68 | 94 | 76 |
| 1355754 | 152 | 81 | 107 | 84 |
| 1355755 | 141 | 79 | 96 | 85 |
| 1355756 | 177 | 78 | 118 | 87 |
| 1355757 | 196 | 72 | 129 | 92 |

TABLE 69

Reduction of human PRNP RNA in knock-in mice

| Compound Number | PRNP RNA (% control) | | | |
|---|---|---|---|---|
| | RTS42354 | | RTS42356 | |
| | Cortex | Spinal Cord | Cortex | Spinal Cord |
| PBS | 100 | 100 | 100 | 100 |
| 1393324 | 82 | 56 | 83 | 47 |
| 1393327 | 85 | 55 | 87 | 49 |
| 1393329 | 94 | 56 | 96 | 53 |
| 1393330 | 44 | 30 | 49 | 29 |
| 1393331 | 78 | 57 | 89 | 54 |
| 1393332 | 57 | 29 | 62 | 28 |
| 1393333 | 79 | 64 | 86 | 59 |
| 1393334 | 63 | 41 | 68 | 35 |
| 1393335 | 50 | 30 | 54 | 27 |
| 1393336 | 86 | 84 | 98 | 71 |
| 1393337 | 67 | 56 | 69 | 43 |
| 1393338 | 81 | 76 | 90 | 70 |
| 1393339 | 78 | 65 | 86 | 52 |
| 1393340 | 79 | 79 | 87 | 66 |
| 1393341 | 86 | 85 | 94 | 69 |
| 1393342 | 58 | 46 | 64 | 39 |
| 1394116 | 85 | 80 | 93 | 69 |
| 1394117 | 74 | 60 | 83 | 49 |
| 1394118 | 65 | 51 | 74 | 44 |
| 1394119 | 64 | 51 | 71 | 44 |
| 1394120 | 65 | 50 | 77 | 45 |
| 1394121 | 66 | 54 | 71 | 46 |
| 1394122 | 83 | 53 | 98 | 59 |
| 1394123 | 62 | 45 | 76 | 49 |
| 1394124 | 73 | 35 | 62* | 34* |
| 1394125 | 72 | 55 | 84 | 68 |
| 1394126 | 81 | 72 | 94 | 74 |
| 1394127 | 79 | 58 | 98 | 76 |
| 1394128 | 86 | 61 | 104 | 77 |
| 1394129 | 60 | 51 | 77 | 55 |
| 1394130 | 66 | 40 | 60 | 46 |
| 1394131 | 67 | 47 | 24* | 19* |
| 1394132 | 71 | 55 | 47 | 46 |
| 1394133 | 87 | 72 | 87 | 62 |
| 1394134 | 75 | 51 | 72 | 46 |
| 1394135 | 79 | 60 | 52 | 46 |
| 1394136 | 45 | 32 | 47 | 30 |
| 1394137 | 76 | 66 | 59* | 36* |
| 1394138 | 73 | 62 | 24* | 18* |
| 1394139 | 68 | 58 | 35 | 42 |

TABLE 70

Reduction of human PRNP RNA in knock-in mice

| Compound Number | PRNP RNA (% control) | | | |
|---|---|---|---|---|
| | RTS42354 | | RTS42356 | |
| | Cortex | Spinal Cord | Cortex | Spinal Cord |
| PBS | 100 | 100 | 100 | 100 |
| 1238414 | 90 | 75 | 89 | 72 |
| 1238503 | 68 | 43 | 68 | 42 |
| 1238550 | 58 | 41 | 55 | 41 |
| 1238882 | 71 | 35 | 68 | 38 |
| 1238982 | 86 | 61 | 82 | 57 |
| 1239136 | 59 | 56 | 58 | 57 |
| 1239202 | 77 | 66 | 76 | 64 |
| 1239559 | 70 | 47 | 70 | 47 |
| 1239560 | 81 | 68 | 81 | 65 |
| 1239661 | 63 | 39 | 62 | 38 |
| 1406230 | 77 | 59 | 73 | 52 |
| 1406232 | 50 | 33 | 49 | 32 |
| 1406236 | 86 | 70 | 85 | 66 |
| 1406238 | 65 | 40 | 61 | 39 |
| 1406243 | 54 | 50 | 51 | 48 |
| 1406250 | 99 | 93 | 63 | 91 |
| 1406254 | 60 | 49 | 58 | 44 |
| 1406261 | 56 | 52 | 54 | 47 |
| 1406262 | 38 | 34 | 36 | 31 |
| 1406264 | 85 | 84 | 85 | 80 |
| 1406267 | 69 | 56 | 64 | 49 |
| 1238358 | 63 | 55 | 60 | 51 |
| 1238374 | 51 | 73 | 45 | 64 |
| 1238441 | 89 | 73 | 83 | 70 |
| 1238638 | 81 | 66 | 80 | 66 |

TABLE 70-continued

Reduction of human PRNP RNA in knock-in mice

| Compound | RTS42354 | | RTS42356 | |
|---|---|---|---|---|
| Number | Cortex | Spinal Cord | Cortex | Spinal Cord |
| 1238803 | 72 | 62 | 67 | 60 |
| 1238896 | 51 | 47 | 58 | 46 |
| 1239049 | 68 | 64 | 60 | 60 |
| 1239179 | 78 | 52 | 66 | 49 |
| 1239223 | 79 | 70 | 76 | 67 |
| 1239326 | 68 | 49 | 60 | 49 |
| 1270309 | 68 | 43 | 60 | 36 |
| 1270317 | 66 | 56 | 61 | 56 |
| 1270318 | 62 | 48 | 63 | 46 |
| 1238240 | 54 | 47 | 1* | 4* |
| 1270342 | 54 | 46 | 46 | 43 |

TABLE 71

Reduction of human PRNP RNA in knock-in mice

| Compound | RTS42354 | | RTS42356 | |
|---|---|---|---|---|
| Number | Cortex | Spinal Cord | Cortex | Spinal Cord |
| PBS | 100 | 100 | 100 | 100 |
| 1270363 | 39 | 29 | 31 | 31 |
| 1411004 | 21 | 13 | 13 | 13 |
| 1411005 | 30 | 20 | 19 | 19 |
| 1411006 | 28 | 14 | 15 | 15 |
| 1411007 | 32 | 21 | 19 | 19 |
| 1411013 | 38 | 26 | 26 | 26 |
| 1411014 | 28 | 13 | 13 | 13 |
| 1411015 | 22 | 13 | 12 | 12 |
| 1411016 | 29 | 22 | 21 | 21 |
| 1270381 | 77 | 51 | 45 | 45 |
| 1270459 | 62 | 52 | 46 | 46 |
| 1270530 | 67 | 55 | 43 | 43 |

TABLE 72

Reduction of human PRNP RNA in knock-in mice

| Compound | RTS42354 | | RTS42356 | |
|---|---|---|---|---|
| Number | Cortex | Spinal Cord | Cortex | Spinal Cord |
| PBS | 100 | 100 | 100 | 100 |
| 1270342 | 75 | 47 | 73 | 47 |
| 1270363 | 71 | 37 | 76 | 35 |
| 1406232 | 59 | 37 | 60 | 34 |
| 1406254 | 66 | 71 | 69 | 75 |
| 1406261 | 52 | 35 | 51 | 34 |
| 1406262 | 56 | 43 | 54 | 41 |
| 1411004 | 30 | 17 | 29 | 17 |
| 1411005 | 44 | 24 | 46 | 23 |
| 1411006 | 30 | 18 | 31 | 18 |
| 1411007 | 36 | 26 | 38 | 24 |
| 1411013 | 44 | 28 | 44 | 27 |
| 1411014 | 33 | 25 | 34 | 23 |
| 1411015 | 25 | 21 | 24 | 18 |
| 1411016 | 42 | 25 | 44 | 21 |
| 1411017 | 80 | 38 | 76 | 35 |
| 1411018 | 81 | 56 | 79 | 52 |

TABLE 73

Reduction of human PRNP RNA in knock-in mice

| Compound | RTS42354 | | RTS42356 | |
|---|---|---|---|---|
| Number | Cortex | Spinal Cord | Cortex | Spinal Cord |
| PBS | 100 | 100 | 100 | 100 |
| 1418386 | 35 | 19 | 13* | 8* |
| 1418387 | 53 | 29 | 46 | 28 |
| 1418388 | 68 | 58 | 16* | 15* |
| 1418389 | 76 | 48 | 54 | 46 |
| 1418390 | 68 | 34 | 36* | 20* |
| 1418391 | 67 | 38 | 60* | 35* |
| 1418392 | 63 | 27 | 52* | 25* |
| 1418393 | 68 | 34 | 48* | 25* |
| 1418394 | 97 | 81 | 69 | 66 |
| 1418395 | 74 | 48 | 77 | 49 |
| 1418396 | 84 | 60 | 80 | 49 |
| 1418397 | 87 | 61 | 76 | 57 |
| 1418398 | 95 | 80 | 89 | 73 |
| 1418399 | 93 | 64 | 90 | 62 |
| 1418400 | 99 | 71 | 94 | 66 |
| 1418401 | 94 | 68 | 91 | 65 |
| 1418402 | 93 | 54 | 84 | 54 |
| 1418403 | 114 | 94 | 105 | 89 |
| 1418404 | 82 | 60 | 85 | 57 |
| 1418405 | 103 | 71 | 92 | 69 |
| 1418406 | 91 | 77 | 79 | 69 |
| 1418416 | 60 | 35 | 37* | 25* |
| 1418417 | 62 | 43 | 62 | 48 |
| 1418418 | 44 | 26 | 41 | 26 |
| 1418419 | 57 | 34 | 52 | 32 |
| 1418420 | 19 | 12 | 18 | 14 |
| 1418421 | 45 | 34 | 45 | 33 |
| 1418422 | 50 | 27 | 50 | 29 |

TABLE 74

Reduction of human PRNP RNA in knock-in mice

| Compound | RTS42354 | | RTS42356 | |
|---|---|---|---|---|
| Number | Cortex | Spinal Cord | Cortex | Spinal Cord |
| PBS | 100 | 100 | 100 | 100 |
| 1418407 | 82 | 68 | 91 | 72 |
| 1418408 | 86 | 85 | 101 | 91 |
| 1418409 | 94 | 95 | 105 | 86 |
| 1418410 | 92 | 85 | 98 | 80 |
| 1418411 | 85 | 67 | 84 | 65 |
| 1418412 | 55 | 39 | 56 | 40 |
| 1418413 | 78 | 45 | 82 | 44 |
| 1418414 | 69 | 44 | 70 | 45 |
| 1418415 | 76 | 45 | 79 | 43 |
| 1418423 | 70 | 38 | 75 | 36 |
| 1418424 | 33 | 21 | 32 | 20 |
| 1418425 | 39 | 22 | 37 | 21 |
| 1418426 | 36 | 31 | 35 | 29 |
| 1423120 | 45 | 29 | 43 | 30 |
| 1423121 | 28 | 23 | 27 | 22 |
| 1423122 | 31 | 14 | 29 | 15 |
| 1423123 | 30 | 20 | 30 | 19 |
| 1423124 | 46 | 28 | 43 | 27 |
| 1423125 | 79 | 48 | 82 | 51 |
| 1423126 | 39 | 29 | 38 | 28 |
| 1423127 | 58 | 40 | 56 | 39 |

TABLE 75

Reduction of human PRNP RNA in knock-in mice

| Compound Number | PRNP RNA (% control) | | | |
|---|---|---|---|---|
| | RTS42354 | | RTS42356 | |
| | Cortex | Spinal Cord | Cortex | Spinal Cord |
| PBS | 100 | 100 | 100 | 100 |
| 1201005 | 56 | 32 | 57 | 24 |
| 1238994 | 46 | 21 | 48 | 22 |
| 1239544 | 52 | 28 | 34 | 17 |
| 1270400 | 57 | 34 | 59 | 28 |
| 1355706 | 55 | 12 | 35 | 12 |
| 1355721 | 98 | 59 | 90 | 57 |
| 1355745 | 83 | 96 | 90 | 65 |
| 1373021 | 36 | 17 | 26 | 14 |
| 1373022 | 33 | 16 | 28 | 16 |
| 1373023 | 27 | 8 | 17 | 10 |
| 1373043 | 43 | 17 | 20* | 9* |
| 1373045 | 66 | 50 | 24* | 13* |
| 1373050 | 62 | 50 | 45 | 32 |
| 1373053 | 32 | 18 | 16* | 10* |
| 1373054 | 72 | 38 | 35 | 13 |
| 1373057 | 62 | 24 | 49 | 12 |
| 1373061 | 94 | 77 | 60 | 43 |

Example 6: Potency of Modified Oligonucleotides Complementary to Human PRNP in Knock-In Mice Modified oligonucleotides described above were tested in human PRNP knock-in mouse model as described above.

Treatment

The PRNP knock-in mice were divided into groups of 3-4 mice each. Each mouse received a single ICV bolus of modified oligonucleotide at the doses indicated in tables below. A group of 4 mice received PBS as a negative control for each study. Each table below represents an independent study.

RNA Analysis

Two weeks post treatment, mice were sacrificed and RNA was extracted from cortical brain tissue, spinal cord, and brain stem for RTPCR analysis to measure amount of PRNP RNA using human primer probe set RTS42356 (described herein above). In some cases, levels of PRNP RNA in hippocampus were examined as well. Results are presented as percent human PRNP RNA relative to PBS control, normalized to mouse cyclophilin A. Cyclophilin A was amplified using primer probe set m_cyclo24 (described herein above). N/A indicates that a value is not available.

As shown in the table below, treatment with modified oligonucleotides resulted in reduction of PRNP RNA in comparison to the PBS control.

TABLE 76

Reduction of human PRNP RNA in knock-in mice

| Compound No. | Dose (µg) | CORTEX | | SPINAL CORD | | BRAIN STEM | |
|---|---|---|---|---|---|---|---|
| | | PRNP RNA (% control) | ED50 (µg) | PRNP RNA (% control) | ED50 (µg) | PRNP RNA (% control) | ED50 (µg) |
| 1201142 | 10 | 94 | 196 | 87 | 37 | 81 | 46 |
| | 30 | 97 | | 51 | | 66 | |
| | 100 | 70 | | 34 | | 44 | |
| | 300 | 44 | | 24 | | 26 | |
| | 700 | 39 | | 21 | | 23 | |
| 1270232 | 10 | 89 | 102 | 68 | 22 | 80 | 36 |
| | 30 | 69 | | 49 | | 62 | |
| | 100 | 65 | | 32 | | 39 | |
| | 300 | 29 | | 16 | | 18 | |
| | 700 | 19 | | 15 | | 19 | |
| 1270458 | 10 | 89 | 143 | 87 | 36 | 82 | 57 |
| | 30 | 82 | | 45 | | 61 | |
| | 100 | 56 | | 41 | | 45 | |
| | 300 | 45 | | 25 | | 34 | |
| | 700 | 27 | | 24 | | 27 | |

TABLE 77

Reduction of human PRNP RNA in knock-in mice

| Compound No. | Dose (µg) | CORTEX | | SPINAL CORD | | BRAIN STEM | |
|---|---|---|---|---|---|---|---|
| | | PRNP RNA (% control) | ED50 (µg) | PRNP RNA (% control) | ED50 (µg) | PRNP RNA (% control) | ED50 (µg) |
| 1238994 | 10 | 95 | 124 | 82 | 44 | 73 | 33 |
| | 30 | 73 | | 64 | | 57 | |
| | 100 | 63 | | 33 | | 39 | |
| | 300 | 37 | | 28 | | 25 | |
| | 700 | 28 | | 22 | | 18 | |
| 1270400 | 10 | 89 | 262 | 63 | 24 | 65 | 29 |
| | 30 | 94 | | 55 | | 60 | |
| | 100 | 62 | | 40 | | 38 | |
| | 300 | 48 | | 22 | | 24 | |
| | 700 | 47 | | 20 | | 23 | |
| 1355721 | 10 | 104 | >700 | 86 | 374 | 78 | 637 |
| | 30 | 84 | | 74 | | 78 | |
| | 100 | 84 | | 66 | | 73 | |
| | 300 | 75 | | 58 | | 60 | |
| | 700 | 75 | | 50 | | 52 | |

TABLE 78

Reduction of human PRNP RNA in knock-in mice

| Compound No. | Dose (µg) | CORTEX | | SPINAL CORD | | BRAIN STEM | |
|---|---|---|---|---|---|---|---|
| | | PRNP RNA (% control) | ED50 (µg) | PRNP RNA (% control) | ED50 (µg) | PRNP RNA (% control) | ED50 (µg) |
| 1239544 | 10 | 103 | 310 | 77 | 70 | 90 | 91 |
| | 30 | 105 | | 76 | | 74 | |
| | 100 | 75 | | 46 | | 50 | |
| | 300 | 62 | | 32 | | 35 | |
| | 700 | 34 | | 24 | | 27 | |
| 1355706 | 10 | 95 | 105 | 75 | 45 | 76 | 33 |
| | 30 | 81 | | 78 | | 61 | |
| | 100 | 59 | | 28 | | 38 | |
| | 300 | 28 | | 17 | | 14 | |
| | 700 | 19 | | 14 | | 11 | |
| 1373021 | 10 | 99 | 118 | 98 | 53 | 85 | 40 |
| | 30 | 82 | | 65 | | 60 | |
| | 100 | 62 | | 40 | | 34 | |
| | 300 | 30 | | 17 | | 18 | |
| | 700 | 18 | | 9 | | 12 | |

TABLES 79

Reduction of human PRNP RNA in knock-in mice

| Compound No. | Dose (µg) | CORTEX PRNP RNA (% control) | ED50 (µg) | SPINAL CORD PRNP RNA (% control) | ED50 (µg) | BRAIN STEM PRNP RNA (% control) | ED50 (µg) | HIPPOCAMPUS PRNP RNA (% control) | ED50 (µg) |
|---|---|---|---|---|---|---|---|---|---|
| 1355720 | 30 | 84 | 88 | 54 | 27 | 53 | 27 | 68 | 57 |
|  | 100 | 49 |  | 29 |  | 39 |  | 43 |  |
|  | 300 | 27 |  | 19 |  | 23 |  | 25 |  |
|  | 700 | 17 |  | 17 |  | 21 |  | 21 |  |
| 1373022 | 10 | 95 | 126 | 79 | 50 | 79 | 41 | N/A | 98 |
|  | 30 | 77 |  | 61 |  | 64 |  | 75 |  |
|  | 100 | 67 |  | 40 |  | 45 |  | 59 |  |
|  | 300 | 34 |  | 23 |  | 27 |  | 30 |  |
|  | 700 | 20 |  | 14 |  | 19 |  | 22 |  |
| 1373023 | 10 | 72 | 69 | 88 | 27 | 76 | 30 | N/A | 49 |
|  | 30 | 73 |  | 59 |  | 56 |  | 69 |  |
|  | 100 | 49 |  | 26 |  | 32 |  | 36 |  |
|  | 300 | 25 |  | 14 |  | 17 |  | 21 |  |
|  | 700 | 11 |  | 10 |  | 13 |  | 12 |  |
| 1373057 | 10 | 88 | 98 | 100 | 44 | 86 | 51 | N/A | 55 |
|  | 30 | 74 |  | 65 |  | 68 |  | 65 |  |
|  | 100 | 55 |  | 33 |  | 38 |  | 46 |  |
|  | 300 | 34 |  | 19 |  | 24 |  | 27 |  |
|  | 700 | 18 |  | 16 |  | 17 |  | 20 |  |

TABLES 80

Reduction of human PRNP RNA in knock-in mice

| Compound No. | Dose (µg) | CORTEX PRNP RNA (% control) | ED50 (µg) | SPINAL CORD PRNP RNA (% control) | ED50 (µg) | BRAIN STEM PRNP RNA (% control) | ED50 (µg) | HIPPOCAMPUS PRNP RNA (% control) | ED50 (µg) |
|---|---|---|---|---|---|---|---|---|---|
| 1411016 | 10 | 95 | 80 | 86 | 44 | 85 | 51 | N/A | 82 |
|  | 30 | 84 |  | 56 |  | 62 |  | 99 |  |
|  | 100 | 45 |  | 41 |  | 42 |  | 81 |  |
|  | 300 | 29 |  | 26 |  | 27 |  | 39 |  |
|  | 700 | 26 |  | 23 |  | 22 |  | 31 |  |

Example 7: Tolerability of Modified Oligonucleotides Complementary to Human PRNP in Wild-Type Mice, 3-Hour Study Modified oligonucleotides described above were tested in wild-type female C57/B16 mice to assess the tolerability of the oligonucleotides. Also tested in one study was Comparator Compound No. 169753, described herein above and in WO2010/019270. Wild-type female C57/B16 mice each received a single 1CV dose of 700 gig of modified oligonucleotide listed in the table below. Each treatment group consisted of 2-4 mice. A group of 4 mice received PBS as a negative control for each study (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a sub-score of 0 if it met the criteria and 1 if it did not (the functional observational battery score or FOB). After all 7 criteria were evaluated, the scores were summed for each mouse and the summed scores for each animal are reported individually. The results are presented in the tables below.

TABLE 81

Tolerability scores in mice at 700 µg dose

| Compound Number | 3 hr. FOB |
|---|---|
| PBS | 0, 0, 0, 0 |
| 1238169 | 1, 3, 1, 3 |
| 1200973 | 4, 4, 5, 5 |
| 1201005 | 5, 5, 7, 4 |
| 1201010 | 4, 4, 4, 4 |
| 1201142 | 1, 1, 2, 2 |
| 1201293 | 4, 4, 3, 6 |
| 1238167 | 1, 1, 1, 1 |
| 1238168 | 1, 1, 1, 1 |
| 1238339 | 5, 5, 5, 5 |
| 1238467 | 6, 6, 6, 6 |
| 1238497 | 4, 4, 4, 4 |
| 1238498 | 3, 3, 3, 3 |
| 1238507 | 6, 6, 6, 6 |
| 1238517 | 5, 5, 5, 5 |
| 1238812 | 1, 1, 1, 1 |
| 1238814 | 0, 0, 0, 0 |
| 1238987 | 1, 1, 1, 1 |
| 1238996 | 1, 1, 1, 1 |
| 1239009 | 5, 5, 5, 5 |
| 1239031 | 4, 4, 5, 5 |
| 1239234 | 1, 1, 1, 1 |
| 1239293 | 5, 4, 4, 5 |
| 1239544 | 3, 4, 4, 3 |

TABLE 82

Tolerability scores in mice at 700 µg dose

| Compound Number | 3 hr. FOB |
|---|---|
| PBS | 0, 0, 0, 0 |
| 1239030 | 1, 1, 1, 1 |
| 1270228 | 6, 6, 6, 5 |
| 1270230 | 3, 3, 3, 3 |
| 1270231 | 1, 1, 1, 1 |
| 1270232 | 2, 2, 2, 2 |
| 1270406 | 1, 1, 1, 1 |
| 1270457 | 1, 1, 1, 1 |
| 1270458 | 1, 1, 1, 1 |
| 1335684 | 1, 0, 0, 0 |
| 1335686 | 0, 0, 0, 0 |
| 1335688 | 1, 1, 0, 0 |

TABLE 83

Tolerability scores in mice at 700 µg dose

| Compound Number | 3 hr. FOB |
|---|---|
| PBS | 0, 0, 0, 0 |
| 169753 | 6, 3, 4, 4 |
| 1238994 | 0, 0, 0, 0 |
| 1239235 | 0, 0, 0, 0 |
| 1270233 | 2, 1, 1, 3 |
| 1270281 | 4, 4, 3, 1 |
| 1270400 | 0, 1, 0, 1 |
| 1355706 | 4, 5, 4, 3 |
| 1355708 | 3, 5, 4, 3 |

TABLE 84

Tolerability scores in mice at 700 µg dose

| Compound Number | 3 hr. FOB |
|---|---|
| PBS | 0, 0, 0, 0 |
| 1201004 | 3, 3, 2, 2 |
| 1201006 | 3, 4, 4, 4 |
| 1201007 | 4, 3, 4, 4 |
| 1201141 | 1, 2, 1, 2 |
| 1238202 | 0, 0, 0, 0 |
| 1239543 | 1, 1, 2, 1 |
| 1239545 | 0, 0, 0, 0 |
| 1239546 | 1, 0, 1, 0 |
| 1239547 | 0, 0, 0, 0 |
| 1373020 | 4, 4, 4, 3 |
| 1373021 | 3, 3, 2, 2 |
| 1373022 | 2, 2, 2, 1 |
| 1373023 | 0, 0, 0, 0 |
| 1373024 | 1, 1, 1, 0 |
| 1373025 | 0, 0, 0, 1 |
| 1373026 | 2, 1, 1, 1 |
| 1373027 | 1, 2, 3, 2 |
| 1373028 | 0, 0, 0, 0 |
| 1373029 | 1, 2, 1, 1 |
| 1373030 | 1, 2, 2, 1 |
| 1373031 | 1, 1, 1, 1 |
| 1373032 | 0, 0, 1, 0 |
| 1373033 | 3, 2, 4, 4 |

TABLE 85

Tolerability scores in mice at 700 µg dose

| Compound Number | 3 hr. FOB |
|---|---|
| PBS | 0, 0, 0, 0 |
| 1373057 | 0, 0, 0, 0 |
| 1373058 | 0, 0, 3, 0 |
| 1373059 | 0, 0, 0, 0 |
| 1373060 | 0, 0, 0, 4 |
| 1373061 | 0, 0, 0, 0 |
| 1373062 | 1, 4, 1, 1 |
| 1373063 | 0, 0, 0, 0 |
| 1373064 | 0, 0, 0, 0 |
| 1373065 | 0, 0, 0, 0 |
| 1373066 | 0, 0, 0, 0 |
| 1373067 | 0, 1, 0, 0 |
| 1373068 | 0, 0, 0, 0 |
| 1373069 | 0, 0, 0, 0 |
| 1373070 | 6, 5, 5, 5 |
| 1373071 | 0, 0, 0, 0 |
| 1373072 | 6, 4, 4, 4 |
| 1373073 | 0, 0, 0, 0 |
| 1373074 | 1, 1, 0, 1 |
| 1373075 | 0, 0, 0, 0 |
| 1373076 | 0, 0, 0, 0 |
| 1373077 | 0, 0, 0, 0 |
| 1373078 | 4, 3, 4, 4 |

TABLE 86

Tolerability scores in mice at 700 µg dose

| Compound Number | 3 hr. FOB |
|---|---|
| PBS | 0, 0, 0, 0 |
| 1201157 | 3, 3, 3, 1 |
| 1201255 | 7, 6, 6, 7 |
| 1201288 | 3, 6, 6, 3 |
| 1201294 | 6, 7, 4, 5 |
| 1238259 | 1, 1, 1, 1 |
| 1238264 | 1, 1, 1, 1 |
| 1238270 | 6, 7, 7, 6 |
| 1238274 | 3, 3, 3, 1 |
| 1238323 | 1, 3, 3, 2 |
| 1238329 | 4, 4, 4, 5 |
| 1238330 | 7, 6, 7, 7 |
| 1238331 | 7, 7, 7, 7 |
| 1238341 | 4, 4, 6, 3 |
| 1238437 | 0, 1, 0, 1 |
| 1238440 | 1, 1, 1, 1 |
| 1238449 | 4, 5, 4, 6 |
| 1238580 | 2, 5, 3, 2 |
| 1238688 | 1, 1, 1, 1 |
| 1238914 | 1, 1, 1, 1 |
| 1200977 | 6, 4, 7, 4 |
| 1201138 | 1, 3, 4, 2 |
| 1201145 | 3, 3, 4, 6 |
| 1238170 | 0, 0, 0, 0 |

TABLE 87

Tolerability scores in mice at 700 µg dose

| Compound Number | 3 hr. FOB |
|---|---|
| PBS | 0, 0, 0, 0 |
| 1238600 | 0, 0, 0, 0 |
| 1238491 | 1, 1, 1, 1 |
| 1239162 | 0, 0, 0, 0 |

TABLE 87-continued

Tolerability scores in mice at 700 μg dose

| Compound Number | 3 hr. FOB |
|---|---|
| 1238813 | 0, 0, 0, 0 |
| 1238889 | 4, 1, 4, 4 |
| 1238892 | 0, 0, 0, 0 |
| 1238975 | 1, 1, 1, 1 |
| 1238992 | 1, 1, 1, 1 |
| 1239046 | 1, 1, 1, 1 |
| 1239146 | 4, 4, 3, 4 |
| 1239260 | 1, 1, 1, 1 |
| 1239263 | 5, 5, 5, 5 |
| 1239448 | 6, 6, 6, 6 |
| 1239682 | 7, 4, 4, 4 |
| 1239694 | 4, 4, 4, 4 |
| 1238322 | 1, 1, 1, 1 |
| 1238324 | 0, 0, 0, 0 |
| 1238327 | 1, 1, 1, 1 |
| 1238359 | 5, 5, 5, 5 |
| 1238373 | 3, 3, 3, 1 |
| 1238460 | 1, 1, 1, 1 |
| 1238554 | 6, 6, 5, 5 |
| 1238572 | 1, 1, 1, 1 |

TABLE 88

Tolerability scores in mice at 700 μg dose

| Compound Number | 3 hr. FOB |
|---|---|
| PBS | 0, 0, 0, 0 |
| 1238255 | 2, 1, 1, 1 |
| 1238285 | 1, 1, 3, 3 |
| 1238325 | 0, 0, 0, 0 |
| 1238361 | 0, 0, 0, 0 |
| 1238370 | 7, 7, 4, 5 |
| 1238404 | 0, 0, 1, 0 |
| 1238409 | 6, 6, 6, 6 |
| 1238444 | 7, 5, 6, 6 |
| 1238500 | 6, 6, 7, 6 |
| 1238582 | 5, 5, 5, 5 |
| 1238616 | 0, 0, 0, 0 |
| 1238645 | 0, 0, 0, 0 |
| 1238797 | 0, 0, 0, 0 |
| 1238802 | 1, 3, 6, 3 |
| 1238837 | 4, 7, 4, 4 |
| 1238838 | 6, 7, 6, 6 |
| 1238863 | 7, 7, 6, 6 |
| 1238990 | 7, 4, 4, 4 |
| 1239052 | 1, 1, 1, 0 |
| 1239063 | 2, 3, 2, 3 |
| 1239064 | 0, 0, 0, 0 |
| 1239550 | 4, 4, 4, 3 |
| 1239607 | 4, 4, 4, 4 |

TABLE 89

Tolerability scores in mice at 700 μg dose

| Compound Number | 3 hr. FOB |
|---|---|
| PBS | 0, 0, 0, 0 |
| 1238244 | 0, 0, 0, 0 |
| 1238410 | 4, 4, 4, 0 |
| 1238490 | 0, 0, 0, 0 |
| 1238632 | 0, 0, 0, 0 |

TABLE 89-continued

Tolerability scores in mice at 700 μg dose

| Compound Number | 3 hr. FOB |
|---|---|
| 1238836 | 1, 1, 0, 0 |
| 1239027 | 0, 0, 0, 0 |
| 1239231 | 0, 0, 0, 0 |
| 1239250 | 0, 0, 0, 0 |
| 1239329 | 0, 0, 0, 0 |
| 1239345 | 0, 0, 0, 0 |
| 1239352 | 0, 0, 0, 0 |
| 1239394 | 0, 0, 0, 0 |

TABLE 90

Tolerability scores in mice at 700 μg dose

| Compound Number | 3 hr. FOB |
|---|---|
| PBS | 0, 0, 0, 0 |
| 1201095 | 4, 4, 3, 3 |
| 1201124 | 6, 5, 5, 6 |
| 1201276 | 6, 4, 4, 4 |
| 1238293 | 5, 6, 6, 6 |
| 1238316 | 4, 4, 3, 4 |
| 1238334 | 6, 6, 7, 6 |
| 1238351 | 2, 3, 3, 2 |
| 1238369 | 3, 2, 2, 2 |
| 1238371 | 3, 4, 2, 3 |
| 1238402 | 1, 1, 1, 1 |
| 1238501 | 5, 5, 6, 5 |
| 1238506 | 2, 2, 2, 3 |
| 1238805 | 4, 5, 4, 6 |
| 1238864 | 6, 5, 5, 5 |
| 1238947 | 4, 4, 4, 5 |
| 1238974 | 5, 6, 6, 4 |
| 1238981 | 2, 2, 2, 2 |
| 1239010 | 4, 4, 4, 4 |
| 1239222 | 4, 6, 4, 4 |
| 1239792 | 2, 2, 2, 2 |
| 1201098 | 4, 3, 3, 4 |
| 1201120 | 2, 4, 3, 2 |
| 1201143 | 3, 3, 3, 3 |

TABLE 91

Tolerability scores in mice at 700 μg dose

| Compound Number | 3 hr. FOB |
|---|---|
| PBS | 0, 0, 0, 0 |
| 1355721 | 0, 0, 0, 0 |
| 1355745 | 2, 2, 3, 3 |
| 1355736 | 3, 3, 3, 3 |

TABLE 92

Tolerability scores in mice at 700 μg dose

| Compound Number | 3 hr. FOB |
|---|---|
| PBS | 0, 0, 0, 0 |
| 1373034 | 0, 0, 0, 0 |
| 1373035 | 3, 1, 1, 4 |
| 1373036 | 0, 4, 0, 0 |
| 1373037 | 5, 4, 1, 3 |
| 1373038 | 0, 0, 0, 0 |
| 1373039 | 1, 4, 1, 4 |
| 1373040 | 0, 0, 0, 0 |
| 1373041 | 0, 0, 0, 0 |
| 1373042 | 3, 1, 1, 1 |
| 1373043 | 3, 4, 4, 1 |
| 1373044 | 1, 0, 0, 0 |

TABLE 92-continued

Tolerability scores in mice at 700 µg dose

| Compound Number | 3 hr. FOB |
|---|---|
| 1373045 | 4, 4, 5, 4 |
| 1373046 | 6, 4, 5, 4 |
| 1373047 | 0, 0, 0, 0 |
| 1373048 | 6, 6, 6, 6 |
| 1373049 | 0, 0, 0, 0 |
| 1373050 | 0, 0, 0, 0 |
| 1373051 | 0, 2, 2, 0 |
| 1373052 | 6, 5, 3, 4 |
| 1373053 | 4, 0, 0, 0 |
| 1373054 | 0, 0, 0, 0 |
| 1373055 | 3, 4, 1, 1 |
| 1373056 | 0, 0, 0, 0 |

TABLE 93

Tolerability scores in mice at 700 µg dose

| Compound Number | 3 hr. FOB |
|---|---|
| PBS | 0, 0, 0, 0 |
| 1394131 | 1, 2, 1, 1 |
| 1394138 | 0, 0, 0, 0 |
| 1394139 | 0, 0, 0, 0 |

TABLE 94

Tolerability scores in mice at 700 µg dose

| Compound Number | 3 hr. FOB |
|---|---|
| PBS | 0, 0, 0, 0 |
| 1411017 | 0, 0, 0, 0 |
| 1411018 | 0, 0, 0, 0 |
| 1406232 | 0, 0, 0, 0 |
| 1406254 | 0, 0, 0, 0 |
| 1406261 | 3, 3, 3, 3 |
| 1406262 | 0, 0, 0, 0 |
| 1270342 | 2, 3, 1, 1 |
| 1270363 | 6, 6, 6, 6 |
| 1411004 | 7, 6, 6, 6 |
| 1411005 | 3, 3, 3, 3 |
| 1411006 | 6, 6, 5, 5 |
| 1411007 | 0, 0, 0, 0 |
| 1411013 | 4, 4, 4, 4 |
| 1411014 | 3, 4, 4, 4 |
| 1411015 | 4, 4, 5, 5 |
| 1411016 | 2, 1, 2, 2 |

Example 8: Tolerability of Modified Oligonucleotides Complementary to Human PRNP in Rats at 3 Hours Post Dosing, 3 mg Dose Modified oligonucleotides described above were tested in rats to assess the tolerability of the oligonucleotides. Sprague Dawley rats each received a single intrathecal (IT) dose of 3 mg of oligonucleotide listed in the table below. Also tested in one study was Comparator Compound No. 169753, described herein above and in WO2010/019270. Each treatment group consisted of 2-4 rats. A group of 4 rats received PBS as a negative control in each study (represented in separate tables below). At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then summed scores were reported for each individual animal. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1.

TABLE 95

Tolerability scores in rats at 3 mg dose

| Compound Number | 3 hr. FOB |
|---|---|
| PBS | 0, 0, 0, 0 |
| 1200973 | 4, 4, 5, 5 |
| 1201005 | 4, 4, 5, 4 |
| 1201142 | 1, 4, 2, 2 |
| 1238167 | 4, 1, 4, 4 |
| 1238168 | 2, 2, 3, 1 |
| 1238169 | 5, 5, 4, 4 |
| 1238325 | 0, 0, 0, 0 |
| 1238498 | 5, 5, 2, 5 |
| 1238507 | 5, 6, 5, 6 |
| 1238517 | 6, 5, 6, 6 |
| 1238797 | 0, 2, 1, 1 |
| 1238802 | 5, 4, 6, 5 |
| 1238812 | 3, 2, 1, 1 |
| 1238837 | 0, 3, 0, 5 |
| 1238838 | 6, 6, 6, 6 |
| 1238863 | 6, 6, 6, 6 |
| 1238987 | 5, 4, 5, 5 |
| 1239009 | 5, 5, 4, 5 |
| 1239052 | 2, 3, 3, 3 |
| 1239234 | 2, 1, 1, 2 |
| 1239544 | 5, 4, 2, 0 |
| 1239682 | 0, 2, 2, 2 |
| 1239694 | 5, 2, 3, 3 |

TABLE 96

Tolerability scores in rats at 3 mg dose

| Compound Number | 3 hr. FOB |
|---|---|
| PBS | 0, 0, 1, 0 |
| 1239030 | 1, 0, 0, 0 |
| 1270228 | 5, 5, 4, 4 |
| 1270230 | 0, 0, 1, 3 |
| 1270231 | 0, 1, 3, 3 |
| 1270232 | 3, 3, 3, 3 |
| 1270406 | 0, 2, 0, 0 |
| 1270457 | 3, 2, 2, 0 |
| 1270458 | 0, 1, 0, 0 |
| 1335684 | 3, 2, 0, 2 |
| 1335686 | 0, 0, 0, 0 |
| 1335688 | 0, 0, 0, 0 |

TABLE 97

Tolerability scores in rats at 3 mg dose

| Compound Number | 3 hr. FOB |
|---|---|
| PBS | 0, 0, 0, 0 |
| 1201004 | 4, 4, 4, 4 |
| 1201006 | 5, 0, 6, 0 |
| 1201007 | 6, 5, 5, 5 |
| 1201141 | 0, 4, 4, 4 |
| 1238202 | 3, 3, 2, 0 |
| 1239543 | 3, 3, 3, 3 |
| 1239545 | 1, 1, 1, 2 |
| 1239546 | 2, 2, 2, 1 |
| 1239547 | 1, 0, 1, 1 |
| 1373020 | 5, 5, 5, 4 |
| 1373021 | 4, 4, 0, 4 |
| 1373022 | 3, 3, 0, 0 |
| 1373023 | 1, 1, 2, 1 |
| 1373024 | 1, 1, 0, 0 |
| 1373025 | 1, 0, 0, 0 |
| 1373026 | 1, 1, 2, 1 |
| 1373027 | 2, 2, 2, 0 |
| 1373028 | 0, 0, 0, 0 |
| 1373029 | 2, 2, 2, 3 |
| 1373030 | 2, 2, 3, 2 |

TABLE 98

Tolerability scores in rats at 3 mg dose

| Compound Number | 3 hr. FOB |
|---|---|
| PBS | 0, 0, 0, 0 |
| 1373057 | 0, 2, 1, 0 |
| 1373058 | 2, 3, 3, 3 |
| 1373059 | 3, 3, 3, 0 |
| 1373060 | 3, 3, 3, 2 |
| 1373061 | 3, 2, 3, 3 |
| 1373062 | 0, 3, 3, 3 |
| 1373063 | 0, 0, 0, 1 |
| 1373064 | 2, 2, 2, 2 |
| 1373065 | 1, 2, 2, 2 |
| 1373066 | 0, 0, 0, 0 |
| 1373067 | 0, 2, 2, 2 |
| 1373068 | 0, 0, 0, 0 |
| 1373069 | 0, 0, 0, 0 |
| 1373071 | 0, 0, 0, 0 |
| 1373073 | 0, 0, 0, 0 |
| 1373074 | 3, 3, 2, 0 |
| 1373075 | 2, 2, 3, 3 |
| 1373076 | 0, 0, 0, 0 |
| 1373077 | 0, 0, 0, 0 |
| 1373078 | 4, 4, 3, 2 |

TABLE 99

Tolerability scores in rats at 3 mg dose

| Compound Number | 3 hr. FOB |
|---|---|
| PBS | 0, 0, 0, 0 |
| 1201154 | 6, 6, 4, 0 |
| 1201293 | 4, 4, 4, 4 |
| 1238339 | 0, 3, 0, 3 |
| 1238351 | 0, 3, 2, 0 |
| 1238361 | 0, 0, 1, 1 |

TABLE 99-continued

Tolerability scores in rats at 3 mg dose

| Compound Number | 3 hr. FOB |
|---|---|
| 1238402 | 0, 1, 1, 1 |
| 1238404 | 1, 1, 1, 1 |
| 1238500 | 6, 4, 4, 3 |
| 1238501 | 3, 4, 5, 0 |
| 1238506 | 3, 3, 3, 3 |
| 1238805 | 6, 3, 4, 5 |
| 1238814 | 1, 1 |
| 1238864 | 4, 3, 3, 3 |
| 1238947 | 6, 0, 0, 7 |
| 1238974 | 4, 5, 0, 4 |
| 1238990 | 5, 3, 4, 0 |
| 1238996 | 0, 4, 5, 3 |
| 1239010 | 4, 5, 5, 5 |
| 1239031 | 3, 2, 3, 2 |
| 1239063 | 4, 4, 3, 1 |
| 1239222 | 6, 6, 6, 5 |
| 1239293 | 5, 0, 0, 6 |
| 1239396 | 4, 3, 5, 3 |

TABLE 100

Tolerability scores in rats at 3 mg dose

| Compound Number | 3 hr. FOB |
|---|---|
| PBS | 0, 0, 0, 0 |
| 1201255 | 6, 5, 5, 6 |
| 1201288 | 5, 5, 5, 5 |
| 1238264 | 4, 5, 5, 5 |
| 1238270 | 7, 6, 0, 6 |
| 1238274 | 5, 5, 5, 5 |
| 1238293 | 5, 6, 6, 6 |
| 1238316 | 0, 5, 0, 5 |
| 1238323 | 1, 5, 5, 5 |
| 1238329 | 6, 6, 5, 6 |
| 1238330 | 6, 5, 6, 6 |
| 1238331 | 2, 6, 6, 6 |
| 1238341 | 6, 6, 5, 6 |
| 1238369 | 5, 5, 3, 5 |
| 1238437 | 4, 4, 4, 0 |
| 1238449 | 6, 0, 6, 0 |
| 1238580 | 3, 0, 2, 0 |
| 1238914 | 4, 0, 3, 3 |
| 1239064 | 0, 2, 2, 2 |
| 1239329 | 3, 3, 0, 3 |
| 1239352 | 4, 2, 4, 3 |
| 1239607 | 5, 5, 0, 0 |

TABLE 101

Tolerability scores in rats at 3 mg dose

| Compound Number | 3 hr. FOB |
|---|---|
| PBS | 0, 0, 0, 0 |
| 1200977 | 2, 6, 6, 6 |
| 1238170 | 3, 2, 0, 2 |

TABLE 101-continued

Tolerability scores in rats at 3 mg dose

| Compound Number | 3 hr. FOB |
|---|---|
| 1238244 | 0, 4, 4, 3 |
| 1238410 | 3, 3, 3, 3 |
| 1238490 | 2, 2, 2, 2 |
| 1239027 | 2, 2, 2, 2 |
| 1239250 | 2, 2, 2, 2 |

TABLE 102

Tolerability scores in rats at 3 mg dose

| Compound Number | 3 hr. FOB |
|---|---|
| PBS | 0, 0, 0, 1 |
| 1238322 | 3, 3, 3, 3 |
| 1238324 | 0, 0, 0, 0 |
| 1238327 | 2, 2, 3, 0 |
| 1238359 | 0, 0, 0, 0 |
| 1238373 | 2, 2, 1, 1 |
| 1238460 | 2, 2, 2, 2 |
| 1238491 | 2, 0, 1, 1 |
| 1238554 | 2, 4, 4, 3 |
| 1238572 | 2, 2, 2, 2 |
| 1238600 | 0, 0, 0, 0 |
| 1238813 | 0, 1, 0, 0 |
| 1238889 | 0, 4, 1, 3 |
| 1238892 | 0, 0, 0, 0 |
| 1238975 | 0, 3, 2, 2 |
| 1238992 | 1, 2, 2, 1 |
| 1239046 | 2, 1, 1, 1 |
| 1239146 | 3, 3, 4, 1 |
| 1239162 | 1, 0, 1, 2 |
| 1239260 | 3, 3, 3, 2 |
| 1239263 | 3, 3, 4, 4 |
| 1239448 | 4, 0, 4, 3 |

TABLE 103

Tolerability scores in rats at 3 mg dose

| Compound Number | 3 hr. FOB |
|---|---|
| PBS | 0, 0, 0, 0 |
| 1201010 | 5, 4, 6, 6 |
| 1201095 | 6, 6, 6, 6 |
| 1201098 | 5, 6, 5, 6 |
| 1201120 | 4, 4, 6 |
| 1201124 | 6, 4, 6, 6 |
| 1201276 | 6, 6, 2 |
| 1201294 | 5, 5, 5, 4 |
| 1238259 | 3, 3, 3, 3 |
| 1238285 | 3, 3, 4, 3 |
| 1238334 | 6, 6, 6, 6 |
| 1238370 | 3, 3, 3, 3 |
| 1238371 | 3, 4 |
| 1238409 | 4, 4, 3, 4 |
| 1238440 | 3, 3, 3, 3 |
| 1238444 | 6, 5, 5, 6 |
| 1238467 | 6, 6, 6 |
| 1238497 | 4, 4, 4, 3 |
| 1238582 | 2, 3, 2, 3 |
| 1238645 | 2, 2 |
| 1238688 | 1, 1, 0, 0 |
| 1238981 | 1, 1, 0, 0 |
| 1239045 | 0, 0, 0, 0 |
| 1239792 | 3, 2, 3 |

TABLE 104

Tolerability scores in rats at 3 mg dose

| Compound Number | 3 hr. FOB |
|---|---|
| PBS | 0, 0, 0, 0 |
| 1355721 | 1, 2, 0, 1 |
| 1355745 | 3, 3, 0, 3 |
| 1355736 | 3, 0 |

TABLE 105

Tolerability scores in rats at 3 mg dose

| Compound Number | 3 hr. FOB |
|---|---|
| PBS | 0, 0, 0, 0 |
| 1373031 | 3, 3, 0, 3 |
| 1373032 | 0, 0, 0, 0 |
| 1373033 | 4, 3, 3, 4 |
| 1373034 | 1, 1, 1, 1 |
| 1373035 | 3, 3, 3, 3 |
| 1373036 | 3, 3, 2, 2 |
| 1373037 | 3, 0, 3, 2 |
| 1373038 | 1, 0, 1, 0 |
| 1373039 | 2, 2, 2, 3 |
| 1373040 | 1, 1, 1, 1 |
| 1373041 | 2, 2, 2, 2 |
| 1373042 | 0, 0, 1, 1 |
| 1373043 | 2, 3, 3, 3 |
| 1373044 | 2, 3, 2, 2 |
| 1373047 | 0, 2, 2, 0 |
| 1373049 | 1, 2, 2, 1 |
| 1373050 | 2, 2, 2, 3 |
| 1373051 | 3, 3, 3, 3 |
| 1373052 | 3, 0, 3, 3 |
| 1373054 | 0, 1, 2, 2 |
| 1373055 | 4, 2, 2, 3 |
| 1373056 | 1, 1, 0, 0 |

TABLE 106

Tolerability scores in rats at 3 mg dose

| Compound Number | 3 hr. FOB |
|---|---|
| PBS | 0, 0, 0, 0 |
| 169753 | 6, 5, 5, 6 |
| 1239235 | 0, 0, 0, 0 |
| 1270233 | 5, 5, 5, 3 |
| 1270281 | 4, 5 |
| 1270400 | 1, 2, 1, 1 |
| 1355708 | 4, 4, 4, 4 |

TABLE 107

Tolerability scores in rats at 3 mg dose

| Compound Number | 3 hr. FOB |
|---|---|
| PBS | 0, 0, 0, 0 |
| 1238994 | 1, 1, 1, 1 |
| 1373053 | 2, 2, 2, 2 |

TABLE 108

Tolerability scores in rats at 3 mg dose

| Compound Number | 3 hr. FOB |
|---|---|
| PBS | 0, 0, 0, 0 |
| 1411017 | 0, 2, 2, 2 |
| 1411018 | 1, 1, 0, 1 |
| 1406232 | 0, 0, 0, 0 |
| 1406254 | 0, 0, 0, 0 |
| 1406261 | 3, 0, 0, 3 |
| 1406262 | 0, 0, 0, 0 |
| 1270342 | 3, 3, 3, 3 |
| 1270363 | 3, 4, 4, 1 |
| 1411004 | 5, 5, 4, 4 |
| 1411005 | 3, 3, 4, 4 |
| 1411006 | 5, 5, 4, 5 |
| 1411007 | 3, 3, 3, 3 |
| 1411013 | 4, 3, 4, 4 |
| 1411014 | 4, 0, 4, 4 |
| 1411015 | 5, 5, 5, 5 |
| 1411016 | 3, 3, 3, 4 |

TABLE 109

Tolerability scores in rats at 3 mg dose

| Compound Number | 3 hr. FOB |
|---|---|
| PBS | 0, 0, 0, 0 |
| 1355720 | 4, 4, 4 |
| 1373045 | 2, 3, 2, 0 |
| 1373046 | 4, 3 |
| 1373048 | 3, 3, 0, 3 |
| 1373053 | 2, 0, 2, 2 |
| 1394131 | 3, 3, 3, 3 |
| 1394138 | 0, 0, 0, 0 |
| 1394139 | 0, 0, 0, 0 |

TABLE 110

Tolerability scores in rats at 3 mg dose

| Compound Number | 3 hr. FOB |
|---|---|
| PBS | 0, 0, 0, 0 |
| 1355706 | 4, 3, 4, 3 |
| 1406262 | 1, 1, 1, 1 |

Example 9: Tolerability of Modified Oligonucleotides Complementary to Human PRNP in Rats, Long-Term Assessment In separate studies run under the same conditions, modified oligonucleotides described above were tested in Sprague Dawley rats to assess the long-term tolerability of the oligonucleotides. Also tested was Comparator Compound No. 169753, described herein above and in WO2010/019270. Sprague Dawley rats each received a single intrathecal (IT) delivered dose of 3 mg of oligonucleotide or PBS. Each animal was weighed and evaluated weekly by a trained observer for adverse events. Adverse events were defined as neurological dysfunction not typical in PBS-treated control animals, including, but not limited to: abnormal limb splay, abnormal gait, tremors, abnormal respiration, paralysis, and spasticity. The onset of an adverse event is defined as the week post-dosing when the dysfunction was first recorded. Onset of adverse events typically correlates with a failure to thrive as defined by a lack of body weight gain/maintenance similar to PBS-treated animals. Animals treated with Compound No. 1238994, Compound No. 1373021, Compound No. 1373022, Compound No. 1373023, Compound No. 1373057, and Compound No. 1411016 achieved no adverse events for the duration of the study. In contrast, each animal treated with comparator Compound No. 169753 experienced one or more adverse events by five weeks post treatment.

Example 10: Human Clinical Trial with Modified Oligonucleotides Complementary to Human PRNP Safety, tolerability, pharmacokinetics, pharmacodynamics and efficacy of modified oligonucleotide complementary to human PRNP will be evaluated in a clinical trial setting. Patient safety will be monitored closely during the study. Safety and tolerability evaluations will include: physical examination, standard neurological assessment, vital signs, ECG, AEs and concomitant medications, CSF safety labs, plasma laboratory tests and urinalysis.

SEQUENCE LISTING (2806 sequences)

SEQ ID NO: 1 - DNA, 2808 bp, Homo sapiens
attttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaccaaaaaaaaa

SEQ ID NO: 2 - DNA, 22000 bp, Homo sapiens
catgtcgcatcattccccttcttaaatcttcaagggcttcctatcatatttaattattaaaacccaaacatctgtcatgggctgtcaggccctatggtcactgtctgtatggcttcctgtatcctctttgaggtctgaagtcagagactgtaactatttaattcacactaagtgctcaataaagtggaggaaataattctccttttgtgagaagatgaatttagagtctaacttctttagtttctccttacttgctgaggaggatctatatgatgtggtcaaatcactttcagccaggacacaggagatgggaagggagacttccaaagaatgacttgatgatgctgtgaacctcagcacaatagggctctgtgggcaaacacagtagggtttgacctccaaggacaaaccctacaccccactccccacccagtccggaaaacgactttcactgtttatagtgagatatgggtggttgtggtcatgggagaggcaatgggagtgagtttggaatgaggaattatgcagggccatttgaatagccacttcctgtgggttgcccacccttggagtggttcataaggtcaataaaaacctctaagaatccataggccagaccatcaaccccattgtggcagcttttaaaactggcaacaaggtctttgatactcttcccattgaggagtgggctccatgtcctctgtccttgaatctgggggctatatgactttttttttttcttttctgagacagagtctcgctctgtcgcccaggctgaagtgcaatggtgccatcttggctcactgcaacctctgcctcccgggttcaagcgattctcctgcctcaccctcctgagtagctgagattacaggtgcgcatcaccatgcctggctaatttttgtatttttaatggagacggggtttcaccatgttgcccaggctggtcttgaactcctgacctcaagtaatccatgggcctcggcctcccaaagtgctgggattacaggcatgagccaccgcgcccggcaatggggctatataactgttacgtcaacagcatacagtggaagtgatgctacctgactactgagcccaggcaggaagtggcattgcagcttcttgtttgctgaaactctcacacttggagtcctgagccaacatgtaagaagttcatccaagccgagaccaccagaccatgaggaaaccaggccacacagagaagccgcagctaggcaccgcaatcagcacatctgatcttcaagtcctcctagcccaggtgccactcaggcaagtgcataggcttcagatgactgcaacccccggctatcaaggtacccctagacttagagtcttctcaactgacaccccaaacataatggggcagaatcaagtccccgctgtgcctgtccagctccctggcttaaacaatccattggcataataaaatggtagttgttttaaaccacctaagttgtggggtatttgcagcacatcagtaataaccagaataggtcataagtcaatcccctttggttccctagttctttccctccaagaaatcccaggccatttgagccctttcctgatgggaggaaagcagtcgaccagaaaatacaattcttttgaggaaaagatgggttttagcgtcttggaaccaagcttcacagagcgccttctgccagtgggcagccagccccttgcctaggctgatctggtcacctacttccagccccaccccagctctgtcctcccacccagctctgtcctccctgcaggccctgagcctctaggagactcaaagagacactgtgctgcccgctgaattcatctcccagtgagccatctctgaggaaaggaggtaaggctctgaatgcgatgtcaacctaagcattacataacactgataggttgtaaaatggcctcgctgcctagtgctcattctaactggccacaatccagtcctccctgttgcactgagtcagctccctccaaaggcggcgctttccaggcctcctggttgccctttcccagcagacctttcaagtgctcacccacactcacataaacatggcccaggcactgtttacagcagctctcctctgtgcattctcctggcttctcctgtctctcgccatttgtacccctcccctgcaacttgagtgacagtgattggtcctgagatgcaaatatttgatgcacatatgtttacaatgcagcctcagcttttttttttttttttgtaaagagacaaagagtgagacagggtcttggcctatagccctgtggcccaggctggagtgcagtggcacaattaaagctcactgcagcctctacctcctgggctcaagcaatcctcccatctcagcctccccagtagctgggactacaggactgtgccaccgttcccagcaattttttttattttttgtagaaatggggtctcactatgttgctcactctggtctcaaactcctgagctcaagcaatcttcctgccttggcctctgaaagtgctgggattacaggcctgagccactgcacctggctgtcaacattcttaaatctctttccttacatgcttcctaaacctctcacccaaaactaggagactagatgtcctattttccccagggcatgcctggtttacgcccatttcactttaaaagtgcccaatttgggtaataatttataagatccccctccctctaaatcctgtccttctatcacttcatccttcgctctcctttaaaatgagacagttgtcagcaggaatcctgcgcaagaacacaccaccctgtttcatagaagatatctcaggtaatgtgcaaacacgggtttttaaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcaggtaaacgcccggggtgggaggaacgcgggcgggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcaggttaggaaagctccctttactgcgcgttggggggctgggggagctggcggagccccgttagggaggtcggtggcgccggggtgtctcagcgccccctgcaccccgcgcgggtccggcccagcgggcgatcgctggcgcccagggaactccgggagggccgccagcgggctccgcagggcgcggggcggggaggggcgcctgggggccgcggggctcgcgctccccgcccgttggccgcccctcggaggccgagatcggggcccagaacgccccttggcaaggcctggcgcttccgcgatgcccagagggtgcttggggggatggagagaggggcgcccgccgggggagttccgggagcctcggtgcctcccgccgcagctgcagcgttcctcccgggaggcggcccagcccttcatcctcgccgcctgagcttctccgaggggggctgcagccttgcggccgttgccaccgcctggagaagcggcccacgcggactgacgggcgggggcggggcctcgggcctcggcgggggcggggtccggggaggccccaccctctgttctccaggggcggggagagaggagctgcaggtctgcggcctggccccaggtgcgatggcggaccccagcttggccagtcacattcctcccagtccccctggagggagaacgctggccatggggggctccaaggaacaaccagcctcggatgacgacccttgggtcaccggtctccccacctgtgcggcaggcgccttcacgtttcattattaaacaatggggagaaatccatgtttactgtcctttttaaggaattttttgctcttctctttgaggtggctgtaggaaatagattttttttttaacctcgcaattccaccacggtcacatccatcctcgccatcgcagagccacagctctccgtttttgtttcctagcctccagattctcacacaacacagtgcagtttcactgctgtaatgatgaggatcttcatggccgcgttattttcttgttctgagagcatcacggtttaattagcagttccccatatgatttgaagtgtttcccgtttccttagggaaaactcctggtagaataggattaaggatttttacaaatataattatcaaaaacataggaacagggaattggataaatatgttaaacttctggaaaaatcaacaacgctcttagatttgtagaagaaaggaaaaaatcaccagtggaaaggagcaattttacttacacaaacacagagaaggtcttacagtgaaaaaaagctaaccagtaaggggaaaagcaggcagaggggtaggatgtgatttgtatgttatttatatctaacacaagtcttccacaccgaaaggaaaatattaagattataatagataaatggcaaaatgatgagtcatttacacaataaaatgcaaattagagcatgtttgggttatcattttacatctattaaaataaccaaaataattaatagtaacagcaacccttgctggaaggttgcccaaaacttggcattttcaagtgtctggggaggtggcagggctttggggtcacaaagatggttctgcagtcaattttgtgaccttggacaggctacctaatttcctgatcctccttttgtccattcatagaatggaggaaatgatagctactttctgcgtctgtatgtatgagttattgggggcatttcgaaccagtgacaaacattttgttaagcaatctggtgatgcattaagaagctggaagctgtgacccagaaaccccactcctgagaacttacctgcaatggaagaaacaaacaaacaaaaacaggcatgtattcctagcagaatgatctaaaattagaacacctggaaaagagcctaaatgtataacaccagggcagtagctaagaaaattatgacacattaactgaaatgaacattatgtaaccactaaaaatcatgattttggagcctgtgatatgtggggaaaaactgacaagtaaaaaagtgggttattaactgcacctgcttactctaacgtgaacgcatatgtgaaaaatctgaaaggaaaagcacagaaaatggacgttttcattgaaattgtcggtgatcttaattttcctttggtgaatatattgctctcactaagggcgtttaaaaaatagttcacaggttttaattttttagatgaaatggacccacagttttctgtaagagaaaggagagattgttatatttgctacttagaataaaagatttttagccaacgttgtttcctttttcaaatatttttccatttttttagttgattaatgatttagtaatttgtgtattgggtttttttaagaatcagttcttagattcatttatcaattctagttttttgttgttgtttttaaggactcctgaatatttttcaaaactgaacaatttcagccatgtctgagctttccgtcttcctggaggcacaaatctagtttagctgaaccacaacagattgtacatatcctgcagaacctctgtggtcttaggaaggttgaaagtcaccaaatgtcacagaaaatgagggtcaggaaaggctgtgatcacaagctcttgatccagaggccactcgggtgcatctgtgtgactgacacctcattgcatcatcatttcttgtaaaatcagcttaattttgcagagaaatggccacagatttttagaattatgctgaattatgtaagggagcagccattttaaaaataatgtaatcaaataacaataataacataacagaagtttctgcaccacactgacactgaacatggctgtcaaccaactagccaaaccaaggtgaaagattctctgaacttcagttttaacttacttcgtccattctcccttttcagatcttatttcttcttccaaggcaactatatccactgtgaactgctgcatattaaacattcaaaacatgtctgtatctaacccagtgatggctacagcattataaaataactcctaagtgaatagtgtgtgcagcaattctcacagctaggagaattttttttgtcgatgtgttaaccattcctttttctccaactgcattctacttaaactgttacagtattgtgtgatcactttaagggaggtaatccttcagtgaaaagcattataaatgttgaagattagacccctgaggacctagcactgaagcctgatcacgggtgccaattccctgagaagcttttatagattcccaaatcccatcgctaggcactctctgactggcttgtgatgggttccagcaatgttgttttttaaaagctcctcaggtaattctgatcatggaccaggttggggaccctttgctctgttcagtttgtggtttctaggtgccagtgagaaacccctacccccaatttttgtgcaaaatttttttcagcttacatcaagttctttatgaacctcagaaaattaaaatataacaagggaatttacttagctcagaagagacaagggacattatggggtgaaggtcgggggttgtttgacatttgccccttcccgatgtaactaattaagcttcaagttgtaatgtgttttatgggctagaaggctttagtgcctatatttggatctcagctccaacaccttggactcttacaaccttgggataagttcttactagctctgactctcactccccatctataaatgggaataagatgaacggggtaatttatagattttttagtaccctctctctagttccgctgttttgccattctgctcatgcaccaatgccatgtgatcttattgtagctttgcactctgacacctggcaggtcaagtgcacccttgattatcttctcattaaaaattttcttcagtcttttaagttttgagtataatttcataatgtcttttaaaatctcttttgaattctttttcaaatttatttattttttctttgacagataagattatatgtattgtgtacaaaattagaaagagatcttttcctctaagatctgaaacaagacaagaatgctcacacgcactagttctattcaacatatggtactgcaagtcctagccaggacagttagacaagagaaagaaataaaaagcatccaaatttgaaaggaaaaagttaaattgttcctatttggagacgacatgattttacacttataaaaccctaaagactccaccagaaaaccattagaactaataaattcagtaaagttgcaggatacaaaattaacatacaaaaatcagtagtgtttctatatgccaacagtgaactatcaggaaagaaataaaaagaaagtgccatttacaatagctacaaaataaatatttcagaataaatttagccaagaaggtgaaagatctctacactgaaaactataaaacactgatgaaagaaattcaaggagacacaaatagaaagatagcctgtgctcatggggggataattaatgttgttaaaatgtccatactacccaaagtgacctacagattccatagaatccctatcaaaataccaatgacattcttcacagaaatagaaaaaacaatcctaaaattgggtgaaggtggcatctttgtctcgtttcagatctaagaggaaaagctctcaatttttcaccattaagtatgatgttagctgtgaccttgtcatatgtggcctttattgtgttgaggtacaatgcttctacacctaattcattgagagtttttatcatgaaagaatgttgaattttgtcaaacgctttttctgcatctattgaaatgatcgtatggttattgtctcactctgttactgtgatgtatcacacttattgatttgtgtatgttgaaccatccttgcagccctgggatgaatcccactgtatcatagtaaatgatctttttaatgagctgttgaatttgcttcgctagaattttgttaagaatttttgcacctatgttcatcagggatattggcctatactgccattttcttgtgtgtttttgtgggactttgacatcaggataatgctggtttctcctgttattaatttctagttttataccatcatgcttagaaaaaaaacttgatacgatttcagtctaattaagtttgttaagacttgttttatggcctaacatatgatctgtcttggagcatgctccatgtgctgttgagaagaatgtgtattctgcagctgttggatggaatgtcctgtatttgtctgtttggatccatttggtctaagtgaagtgtaagtctgatgcctccttatttattttctttctaaatctcccgtccaaaaatctaagagatccaaagcaaacagggggttataaaattacctttgaattctgactgaaattgtgtttactttgtagattatttgctggtgacttggtatctttcaatattggtttcccaaacaaaaaacattgtatgtctttctctttttccagtcttcttttatgtctcagtaaaattttgtagcttgcctactacttattttcaggttaaatcctagatattttcaattcttactgccattatgaatgaatgtttttccccatgaaatgtttaactacagctgatttagggactcactgagttttgatttgttgatttgaaaaactaccaccctgttgagctcatgtatttattctaagacattttttgagattttccaggtaaaaaaattatacctagatgaatttatagaacaacctaatagcataaaagcaatagattattgttcaccacattaatgggaatgcctttcctcttaaaattatgatatcttgggctttgtgtttgtgacagcatttctttatgatggaaagagactatccttccagttctatagaaacgttttaaaaatagcttacatttttaaaaatttaggaatgatattgattttcattgaaaacttttcaacatctgaagaaaatcttttcttcctaacctattaatagagctcctgattttcaaccattcttgtattcctaaaataatccatattggtcataatgtattcttcttttactaaactgttaaaataagttgggtgctgtttttttagattttggcacctgtgtgagaggagggtgccatggcagggtggctaagtgtgcccacctgtgtactagcattgaattttgaccctttatcccattggctctaaacactacatctcaggtgaagacgcccaaatgtttatctctactgagttacagattcctataacaattgcttaaattgatactcccacttgaatgtctcataggtgtggcaaagtttacatgtctatactgaaactcttggttttctctcccaggcatgaccctccaccagtttgtcctatttcagtagatggcatcaccgccatctccctggttatggaagtcccagacccgggcaactctcactcctccatccactcaaccagcaggtcttattggctctttctgtaaaatatgtctcatttattcacagcctgctagctgcatggactccatcccaggccacgccaccatcttcctgcagcagtttcttaactggcctctccattccctttcttgtcccactaaattttcttctatttaagaaaaaatgttttgtagacatggggtttcaccatgttgcccaggctggtctcaaactcctgggctcaagcaatcctcctgcctgagcttcccaaagtgctgggattataggcttgagctgagcttttgaaaaaacattctatgatgttactgtcctactaagaccctttaatggctccccactgctttcagaggaaaatagaaatttctctctgtggaccatgaggccctcatgatctgaccctcaccacctccctagtcttagcagtccacctgccactgtctcatggggctccacagatttgatctcctttttggtccttaagcccaccaagctaagtatcttattcaaaactgtgtcctcagcccctagcacaattcttgacccttagaattctgacacttgaaatgtgtgttaagctaatcaataaattattgtgccaggcttggtggcacaataatgtgttgtgggtcacctatatatagctgtggctcacacctataatcccagcactttgggaggctgaggcctgcagattggttgagcccaggaatttgagaccagcctgggcaacatggcaagaccccatcactattaaaaatacaaaaaaaaaaaaaaccaggcgtggtgttgcatacctgtggtcccagctactcaggaggatcacttgagcccactgggtggaggttgcagagagctgagatcatgccactacactttggcctgggtaagaccctgtctcaagaaaaaaaaaaaaaggttatggtactgtaaatattatattacagtgtataatttttgacagctttttttctccatttcttctatggttattggtcagttctagccttctatttttttttttaagctgacacatactggctgggcatggtggctcacacctgtaatctcagcactttgggaggccaagacaggaagatctcttgagcccagaagtttgaggcgagcctgggcaacatagcaagaccccatctctaccagaaaagaaacaacaacaaaaagaaactggcacatactagttattccataaatatttcttaaatgaattaattctaaagttgatttttataatttacatcttaatagaaagacaatccatctcagagatatttttattcattaaggaaagttgcataaagtaatttattaaccttttaaagcattctctaagcctatttccccttatagagatatgttttctagtgatgtgtgtatgttacattttcaaataactcttaattttatttagaaattccacatttttgtgggttttatttattaaattcgattttcatctctattattaatttatgacagtttattttgaagttttctgttttcttccttttgagttgaataatcatttactttattttacttcttctattcagttgtattatccatgttcctctgatagccatgcaggttccaaatcctcacatttttcaacttctttaaaagattttttttgtgctatcctgataagcgttaagtgttatatcattttttttcatttttattatattcttaatgattttgattctctttttctatccttttggttttctttcttaggtaaatgatcagttatatcttttggccatttttttctgttggaattactgtctcttactgctctgtaagaattccttgcaagttctagaaatgaatcctctgttgattttaagtactaaagtcccctttaccattgtgtactctttctattaactttgtccagagtcagctttatcgtgctgaacaagaatctttacattttaatttttttttttaatttttaagttcaagggtacaagtgcaggtttgttccataggtaaactcgtgtcatgggggtttgtcatacagattatttcatcactcaggtactaagcctagtacccattagttatttttcctgatcctctccctcccttagccctccgataggccctagtatgtgttgttcctctgcatgcgtccatgtgttcttatcatttaggtcccacttataaatgagaacatgtagaattgggttttctgttcctgtgtcagtttgcatatccctgcaaagaacatgatctcgttcttttctggggctgcatagtattcgatagcatatatgtaccacactttcattatcccagctatcactgatgggcatttaggttgattccatgtctttgctattgtggatagttttgcaatgaacatacacgtgcatgtgtctttgtaataggatgatttatattcctttgggtatatacctagtaatgggattgctgagtcgaatgatatttccgtctttaggtttttgaggatgtaatcaaattcatcaattatttgccttatggtttgtgctttttgtttaaaaagttcttcccccattcctcctccaggtcacaaagacatttcccaatattttcctcttctagcgccaaacttgtacctttcacatgtaagtcttggatccatctagagttcacttttgtatgtagttagggatctagttttctttttcttgtttcccagaagcatgaaaccttcctcctttattggttcgtggtgcccatgtcagcacacatcaagtccctgttaaagtgtatctacgtgggtttctctctcaacttgcttttctgtttcctttggtctctccgtctattcctgagctttaccgtccagtcttcgtcactgtggttttgtagtgatttcatgtctgctttggcagattccctcctctttacactttttttttaaggttgaccttattattcatggacattttcttccccatagaagtttactgaacttctcaaaaaattgagattacctggaattttaactggcattttattgcaactaccagttcatttaggataatggacatctttataatactgagttatcgccatcaagaccatggaatgcctctccatttttttcagaccatcttctgtgttctctgtataatgtgtcacccatcagaagtcttttcttagttaagtcaattcctagacgctttacagtttggttgttactttgaatatctgtattttcttctggtcagttattgctactgtagaggaatgccgttggttttcgtaggctgaccttcagtcccacaaccttgcactctagcgttggttctcatgttatccctgttattctgttggattttctatgtgcatgatcacactaattgcaaatagtgtcagctagagcactttccttgccattcttacacctgttacttctttgcatatggccttggacagcaccttgagtcccatgacaatggatgtccctgttgtatttctgagtgtattcttagcattcttcttagtaataaacaggtattgaccattaccatatacttaataggatatcttgaaatatgccagaggactaggccactacttgactggtgacagagagtatcttagatgtataggcccccagacatgccagtgtcctctctcaccacccatctccactccaaagttgtctggcctcacccaccttctgtgcctggttcttctcctctgtgcttctctcactatgccatgtcctcgcctgttcaggtgtctctaagagctcatagatccttaactcttacagctttaaatgaggcacattcaaagcccgactcagtgtcattccctgcagtctcctcttcctcccatcttacccatttcaggtaatatctccagccagccagagtctactgcagtagctggcacatgaaataaatgtttatttaactgaattgaaaatgttagctggccattgtcaaaaatactattttgtaaatttataaatatggttctctttgtatatccattataaatatttagtatttagtttgattattccttatgctttataacatgtgttttcccattcattcatttatccagcatttattttgcatgtctatgggtcaagcgctctgtctaggaacactgctgtgaacaaaaccaaactcccgccctaaaggagcctgcactcccgtggagaacatgaataataagcacagaggaaataacataatatctcaagtagctgtaactgctccagagaataatgaagccaggaaagggggtgggctagggggtgctgttttaggtagagtgatgggaacagccccactgagcaaactttagccacatgagtagctggaagaaaagccttctaggaccagggaacagcaagtgcaacagccctgagacaggatgggcttgtcagtttgaggagcagtgggaggcctgaaccaggttacatggggcccagccagtatggccacgactttgtgttttatccagagtacaaaggagcctcactgagggacaagggaagtggcatgatgtgacccgcatattaagaggagagcgctcaatggcagccaggggaggagcagggaggctggttgggaggctgttgaagaaatcaggtgagaagtgatggaagcaccgaataagatggtcatgttggaaaaattgagaagctgaggtgcttagcattgattttcaaggtagagctactgagatttgctgatagatccaatgtatgctgggagagaaaattcagtcactctagagcattggctggatttgtcacccattgcagcgaatggagaaggtgctgacataaaagccctttagactgaaagctactgactgaggggatggtgccctagtttgatttcctggggtgtatgagtagcagggaggccaagagctgggcctcacgagattgtggggactacatcagggaagcaggcctgcaaagaacctgcaccacagacccccacctaaaagagcctccaaaaaccctaactggcatgacctgagtactttaactctgcttgtaactttcaaatatattttgatttgcttatgaccaccaaggcaaaacttcccatttcaataatgttagtagaaacataaacaggatgttaatttatttatttggtaattctttttatgaatattatccagtttaatcattagctctgaaggagatgaaaaataattttctaatttttagaaaaatttgcagctaattgggtgataaaggtaaggggtttctgagttcacaaaaatgttctaaaattggcaacagtttcggttgcacgtttcattaaatgtactaaaaaccattgaactgtacatggtatatggtgaattatatggtatgtgaattatatctcaacaagctgggtattgtttttttaaaaaataaaaataaaaaaggagaaagagagagagaaaaacaattgcagatcatcccagcactgaggacaagactaacttcagtgttccagtatatgccattataggttttacggcacacagtgatgatttggagcctatgatttgacctagggtacagcaggtactgtttagcaatcattttactattgtcataggtctctgctcttggagctaagtgcccagggtaaatgagatctttaatttgaaaagagatttttgatttgatgaatgtacattctccaaagggtcataaattgtcattctggatgtttgatctgtttgttgttttggtacaaaaattagaagaaaataattcactcataaaatgttaaataatgaactaaaagtcattcatcaagtccataacttagggtcacatttgtccttggagcaggagaaagagttgtgttcacccttttcttacttttgcttttgtcctaagtgcttcagagaagtacagggtggcaacagtgtttctactgagcagctgataccattgctatgcactcattcattatgcaggaaacatttagtaatttcaacataaatatgggactctgacgttctcctcttcattttgcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacctcccgtgtctgcagttgtatttcctggtgcttgccctgtgttggggactgttttgggggttaatctgagccaagtggcgctttctgtcctcccttctcaagtgatggccgatggttcacgcacttccccctgttcctgcccttgtcctcacttcccagtcacccactagttcatctctgcggcttttgcattttctccacaagcatctaagtgggcttagcactggtaaactgcaaaggcactattgcagcaggaggaacagtctgggagcttttttcagtcctggatttagaaatagattttcttgattaaaatgaaaattaacaagctctaaagaactgttgacccttgaactacacagggattagaggcactgacctgccgcacagtcgaaaatctgcagagaagttttttttgttttgttttgttttttttgagacggagtctcgctctgtcgcccaggctggagtgcagtggcgggatctcggctcactgcaacctccgcctcccgggttcaggcgattctcctgcctcagcctcctgagtagctgggactacaggcatatgccaccatgcccggctaatttttgtatttttagtagagatggagtttcaccatattggccaggctgttctcaaactcggcctcaagtgatctgctcgcctcagccacccaaagtgctaggattacaagcatgagccaccgcgcccggcctgcatagaacttttaactcccccaaaacttaattgctaatagattaattgcctgctgttggctggaagccttaccaataacgtaaacagttggttagcacatatttcacatgtcatatatactatatactgtattcttaccataaagtaagttagagaaaatgttgttaaaacaatgaggaaggaaaagtatatttactattcactgactggaagtggatcatcataaagatcttcatctcatcttcctcacattgaggaaggctgaggaggaaggggaggggttggtcttgctgtctcctgggtggcagaggcagaagaaaatctgtgtctcgtggactcagttccaacccgtggtgttcaagggtcacctgtgcctgctttatgcaccccaaatcaggctctaaaatagtctcaggtcctgtgagccttagtgacacactcttctcagattcaatacctttgatctgaaaggtgactttgatttgtcataatcttccaactcattctctacatgtttcgacgcaccagcactgtgatgttcttggttatccttggcagaagttttctcctgcaactaatttgctaaaggcagggggtaatcagaagtgacagtggttgaaatcacaggccaatatcttagcaaacgtctgtgttgtaaatggggaagtgcctctggtggggtcttcaaggatcactccagcctggctagggaaactctaggggagaggcacttgaaattattgtactcataggtcctagagagggaggcatgtcatgccaagcagggggctggattggaggcgtgcccagggattgggtgcaactcagcgtgtatgagacagaaagagagagaactcctgggcaagtgcctttactgggagccaggatggaggacacaagcacaaggtgtaaggggatctcactggtgtgtttgaatgtcactaagtcacagtcaggggaagacaagaagtggaacttgtggcagggaccagccttattacactggcacctggttacctggacagggtgcccactgcctatttgtaggatgtcaaggtatcaggaaaatatgaagtttttaaaaatttacaatataatgccaacctcctacggtgatcagaggatcagctttgtattaaagatggaaagataccaatcatcacccacaaaactactaaaacagaaagaatgacaaatacaattctcggccaggcacagttgctcacgcctgtaatccctgcactttgggaggccgaggcaggcagatcacttgaggtcaggagttcaagaccagcctggccaacatggtgaaacccccattccctactaaaattacaaaaaattagctgggtgtggtcgcacgtgcctgtaatcccagctactcaggaggctgaggcaggagaatcgcttataaccgggaggcagaggctgcagtgagccgagatcccgccattgcactccagcctggcggtaagagcgaaactccgtctcaaaaaaataaaataaaataaacttttcattacctgcctataataatttctcaaaaagagtcaactgaggagacttaaagtgttcgaagcatagctacttgtaggaccagagtgaataatatccacctgtatctttcccaggcctcatgtttcctttgttatttcaaacgtgtgagtcatgcaaaaggaatttttactaaaaaggaaaagaaaaaaatttaaaatgaccagcataaacataattgagttcaatcccccagaaagggttattcggagaacagccaggcgctgcccttgtttttccccctccccatctggggctaagaccaaaaggggtctgtctttggagggaaatctgggtctgtacagcttcccactctaaggggagccttaatcccagccggaacctgagcttctccaggcaaggcctgaccttgccgactgatctaagcattctgcgcttcattttcaccccagaaaggtgacttcctcctggctggggggctcctcccctaggactcagctcatcctgaactaataaccgcgttatgtccatcctttgttccgttctttgagtcccacccatgttcttcaggaaagctgcagctggtccacgtgccttgcctgtgcttctgtagaactacccctcccttctctgcctgcagcagggctcctggaacttgaatgtgcacttgaatctgcaggtcctgactgtaggtctgtgtttctaacatgctgctgggtgacgctgtgcccgtcctgtggtcggcattgtaacaaggctccgcgggttcccacgccggagtctgcgtcagaaacctctggagggcttgttatacacagatggctgaaccccatccccagagtttctgattccctagtaccagggtggggtctgagaatttgcatttctaacaaattcccaggtgatactgatgctgctggtgcggagaggtcacatggaaaccactgctcggcagatgcaaaagaagcagaagccgccccaaccctgaaatactcacaaagctgctgtggagaccagacacctgccgggggaatgagagcctggggatcctgcctgggaggaagagagagctgggagctctatgggtgaatgccaatggaggtgcaaggaggtgactaactcctgccgtctgaaaatagtgaagcacagccgaggcctgaagcccacccttagtgaga

SEQ ID NO: 3 - DNA, 2620 bp, Homo sapiens
gaggcaggtaaacgcccggggtgggaggaacgcgggcgggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaccaaaaaaaaa

SEQ ID NO: 4 - DNA, 806 bp, Homo sapiens
agtcgctgacagccgcggcgccgcgagcttctcctctcctcacgaccgaggcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttc

SEQ ID NO: 5-10 - skipped (6 entries)

SEQ ID NO: 11 - DNA, 20 bp, Artificial sequence
  Synthetic oligonucleotide
tgcatatttcaaagacctgt

SEQ ID NO: 12 - DNA, 22 bp, Artificial sequence
  Primer
ggtggtgtctcactctttcttc

SEQ ID NO: 13 - DNA, 22 bp, Artificial sequence
  Primer
ccagcatctcaggtctactcta

SEQ ID NO: 14 - DNA, 23 bp, Artificial sequence
  Probe
aatacccttggcactgatgggca

SEQ ID NO: 15-17 - skipped (3 entries)

SEQ ID NO: 18 - DNA, 15 bp, Artificial sequence
  Primer
tcgccgcttgctgca

SEQ ID NO: 19 - DNA, 17 bp, Artificial sequence
  Primer
atcggccgtgatgtcga

SEQ ID NO: 20 - DNA, 23 bp, Artificial sequence
  Probe
ccatggtcaaccccaccgtgttc

SEQ ID NO: 21 - DNA, 17 bp, Artificial sequence
  Primer
cctctcctcacgaccga

SEQ ID NO: 22 - DNA, 19 bp, Artificial sequence
  Primer
cccagtgttccatcctcca

SEQ ID NO: 23 - DNA, 25 bp, Artificial sequence
  Probe
ccacaaagagaaccagcatccagca

SEQ ID NO: 24 - DNA, 20 bp, Artificial sequence
  Primer
agtggaacaagccgagtaag

SEQ ID NO: 25 - DNA, 21 bp, Artificial sequence
  Primer
cctcatagtcactgccgaaat

SEQ ID NO: 26 - DNA, 24 bp, Artificial sequence
  Probe
aaccaacatgaagcacatggctgg

SEQ ID NO: 27 - DNA, 20 bp, Artificial sequence
  Synthetic oligonucleotide
ccccgttacataatggagaa

SEQ ID NO: 28 - DNA, 20 bp, Artificial sequence
  Synthetic oligonucleotide
gcctgcgggtgccatcgctc

SEQ ID NO: 29 - DNA, 20 bp, Artificial sequence
  Synthetic oligonucleotide
gttgataccgcctgcgggtg

SEQ ID NO: 30 - DNA, 20 bp, Artificial sequence
  Synthetic oligonucleotide
tgcatcagttgataccgcct

SEQ ID NO: 31 - DNA, 20 bp, Artificial sequence
  Synthetic oligonucleotide
gccgggaatgagtcaccgga

SEQ ID NO: 32 - DNA, 20 bp, Artificial sequence
  Synthetic oligonucleotide
cgggcggccggccgaggttt

SEQ ID NO: 33 - DNA, 20 bp, Artificial sequence
  Synthetic oligonucleotide
cccggcgcacactctgtgcc

SEQ ID NO: 34 - DNA, 20 bp, Artificial sequence
  Synthetic oligonucleotide
ccaattgccgcgcggcccgg

SEQ ID NO: 35 - DNA, 20 bp, Artificial sequence
  Synthetic oligonucleotide
gaggacaggcgacgcgcggg

SEQ ID NO: 36 - DNA, 20 bp, Artificial sequence
  Synthetic oligonucleotide
agcgactggctcggaggaca

SEQ ID NO: 37 - DNA, 20 bp, Artificial sequence
  Synthetic oligonucleotide
gagaggagaagctcgcggcg

SEQ ID NO: 38 - DNA, 20 bp, Artificial sequence
  Synthetic oligonucleotide
aaggttcgccataatgactg

SEQ ID NO: 39 - DNA, 20 bp, Artificial sequence
  Synthetic oligonucleotide
gtatcggctgcccccagtgt

SEQ ID NO: 40 - DNA, 20 bp, Artificial sequence
  Synthetic oligonucleotide
gccccgggtatcggctgccc

SEQ ID NO: 41 - DNA, 20 bp, Artificial sequence
  Synthetic oligonucleotide
tgggtagcggttgcctccag

SEQ ID NO: 42 - DNA, 20 bp, Artificial sequence
  Synthetic oligonucleotide
ccgccctgaggtgggtagcg

SEQ ID NO: 43 - DNA, 20 bp, Artificial sequence
  Synthetic oligonucleotide
tggcttactcggcttgttcc

SEQ ID NO: 44 - DNA, 20 bp, Artificial sequence
  Synthetic oligonucleotide
gcatgtagccgccaaggccc

SEQ ID NO: 45 - DNA, 20 bp, Artificial sequence
  Synthetic oligonucleotide
atgatgggcctgctcatggc

SEQ ID NO: 46 - DNA, 20 bp, Artificial sequence
  Synthetic oligonucleotide
gtcctcatagtcactgccga

SEQ ID NO: 47 - DNA, 20 bp, Artificial sequence
  Synthetic oligonucleotide
gttttcacgatagtaacggt

SEQ ID NO: 48 - DNA, 20 bp, Artificial sequence
  Synthetic oligonucleotide
ggcctgtagtacacttggtt

SEQ ID NO: 49 - DNA, 20 bp, Artificial sequence
  Synthetic oligonucleotide
gctgtactcatccatgggcc

SEQ ID NO: 50 - DNA, 20 bp, Artificial sequence
  Synthetic oligonucleotide
tggtgaccgtgtgctgcttg

SEQ ID NO: 51 - DNA, 20 bp, Artificial sequence
  Synthetic oligonucleotide
aagttctcccccttggtggt

SEQ ID NO: 52 - DNA, 20 bp, Artificial sequence
  Synthetic oligonucleotide
gtcggtctcggtgaagttct

SEQ ID NO: 53 - DNA, 20 bp, Artificial sequence
  Synthetic oligonucleotide
ctgctcaaccacgcgctcca

SEQ ID NO: 54 - DNA, 20 bp, Artificial sequence
  Synthetic oligonucleotide
ctctctggtaataggcctga

SEQ ID NO: 55 - DNA, 20 bp, Artificial sequence
  Synthetic oligonucleotide
cgcctccctcaagctggaaa

SEQ ID NO: 56 - DNA, 20 bp, Artificial sequence
  Synthetic oligonucleotide
aggtggataccgcctccctc

SEQ ID NO: 57 - DNA, 20 bp, Artificial sequence
  Synthetic oligonucleotide
agggtattgattagcctatc

SEQ ID NO: 58 - DNA, 20 bp, Artificial sequence
  Synthetic oligonucleotide
agcaacggctcatgatgaac

SEQ ID NO: 59 - DNA, 20 bp, Artificial sequence
  Synthetic oligonucleotide
ggcctggcattagcaacggc

SEQ ID NO: 60 - DNA, 20 bp, Artificial sequence
  Synthetic oligonucleotide
aacctgttgcactaagtcca

SEQ ID NO: 61 - DNA, 20 bp, Artificial sequence
  Synthetic oligonucleotide
gcattagtatactgagctct

SEQ ID NO: 62 - DNA, 20 bp, Artificial sequence
  Synthetic oligonucleotide
ggcctcctaacaaacctggc

SEQ ID NO: 63 - DNA, 20 bp, Artificial sequence
  Synthetic oligonucleotide
tctcggtacacacagagctc

SEQ ID NO: 64 - DNA, 20 bp, Artificial sequence
  Synthetic oligonucleotide
agctgctgtgtagcccatac

SEQ ID NO: 65 - DNA, 20 bp, Artificial sequence
  Synthetic oligonucleotide
ccacatatagggtcctttaa

SEQ ID NO: 66 - DNA, 20 bp, Artificial sequence
  Synthetic oligonucleotide
gccacatatagggtccttta

SEQ ID NO: 67 - DNA, 20 bp, Artificial sequence
  Synthetic oligonucleotide
cacgcaaaagggtttcccac

SEQ ID NO: 68 - DNA, 20 bp, Artificial sequence
  Synthetic oligonucleotide
tgcacattgtaagcctaagg

SEQ ID NO: 69 - DNA, 20 bp, Artificial sequence
  Synthetic oligonucleotide
tcactcggcccccgcggctc

SEQ ID NO: 70 - DNA, 20 bp, Artificial sequence
  Synthetic oligonucleotide
ccgggcacccttgcgcctgg

SEQ ID NO: 71 - DNA, 20 bp, Artificial sequence
  Synthetic oligonucleotide
cccgagcggagaccagcgca

SEQ ID NO: 72 - DNA, 20 bp, Artificial sequence
  Synthetic oligonucleotide
aagccgcctcacccgagcgg

SEQ ID NO: 73 - DNA, 20 bp, Artificial sequence
  Synthetic oligonucleotide
ccagccccccaacgcgcagt

SEQ ID NO: 74 - DNA, 20 bp, Artificial sequence
  Synthetic oligonucleotide
cgatcgcccgctgggccgga

SEQ ID NO: 75 - DNA, 20 bp, Artificial sequence
  Synthetic oligonucleotide
ctcccggagttccctgggcg

SEQ ID NO: 76 - DNA, 20 bp, Artificial sequence
  Synthetic oligonucleotide
tgggccccgatctcggcctc

SEQ ID NO: 77 - DNA, 20 bp, Artificial sequence
  Synthetic oligonucleotide
ccggaactcccccggcgggc

SEQ ID NO: 78 - DNA, 20 bp, Artificial sequence
  Synthetic oligonucleotide
accgaggctcccggaactcc

SEQ ID NO: 79 - DNA, 20 bp, Artificial sequence
  Synthetic oligonucleotide
acggccgcaaggctgcagcc

SEQ ID NO: 80 - DNA, 20 bp, Artificial sequence
  Synthetic oligonucleotide
cgcccccgcccgtcagtccg

SEQ ID NO: 81 - DNA, 20 bp, Artificial sequence
  Synthetic oligonucleotide
tgaccgtggtggaattgcga

SEQ ID NO: 82 - DNA, 20 bp, Artificial sequence
  Synthetic oligonucleotide
tgctaattaaaccgtgatgc

SEQ ID NO: 83 - DNA, 20 bp, Artificial sequence
  Synthetic oligonucleotide
gcccccaataactcatacat

SEQ ID NO: 84 - DNA, 20 bp, Artificial sequence
  Synthetic oligonucleotide
ggtgcagttaataacccact

SEQ ID NO: 85 - DNA, 20 bp, Artificial sequence
  Synthetic oligonucleotide
tagttggttgacagccatgt

SEQ ID NO: 86 - DNA, 20 bp, Artificial sequence
  Synthetic oligonucleotide
acctcccttaaagtgatcac

SEQ ID NO: 87 - DNA, 20 bp, Artificial sequence
  Synthetic oligonucleotide
agtcagagagtgcctagcga

SEQ ID NO: 88 - DNA, 20 bp, Artificial sequence
  Synthetic oligonucleotide
gcttaattagttacatcggg

SEQ ID NO: 89 - DNA, 20 bp, Artificial sequence
  Synthetic oligonucleotide
agctagtaagaacttatccc

SEQ ID NO: 90 - DNA, 20 bp, Artificial sequence
  Synthetic oligonucleotide
tcttagatttttggacggga

SEQ ID NO: 91 - DNA, 20 bp, Artificial sequence
  Synthetic oligonucleotide
agctctattaataggttagg

SEQ ID NO: 92 - DNA, 20 bp, Artificial sequence
  Synthetic oligonucleotide
gcggtgatgccatctactga

SEQ ID NO: 93 - DNA, 20 bp, Artificial sequence
  Synthetic oligonucleotide
gtggactgctaagactaggg

SEQ ID NO: 94 - DNA, 20 bp, Artificial sequence
  Synthetic oligonucleotide
gctatatataggtgacccac

SEQ ID NO: 95 - DNA, 20 bp, Artificial sequence
  Synthetic oligonucleotide
gcacgataaagctgactctg

SEQ ID NO: 96 - DNA, 20 bp, Artificial sequence
  Synthetic oligonucleotide
tgcaattagtgtgatcatgc

SEQ ID NO: 97 - DNA, 20 bp, Artificial sequence
  Synthetic oligonucleotide
agtggcctagtcctctggca

SEQ ID NO: 98 - DNA, 20 bp, Artificial sequence
  Synthetic oligonucleotide
agttaaggatctatgagctc

SEQ ID NO: 99 - DNA, 20 bp, Artificial sequence
  Synthetic oligonucleotide
cgcttgacccatagacatgc

SEQ ID NO: 100 - DNA, 20 bp, Artificial sequence
  Synthetic oligonucleotide
tgggccccatgtaacctggt

SEQ ID NO: 101 - DNA, 20 bp, Artificial sequence
  Synthetic oligonucleotide
tcctcttaatatgcgggtca

SEQ ID NO: 102 - DNA, 20 bp, Artificial sequence
  Synthetic oligonucleotide
gaccatcttattcggtgctt

SEQ ID NO: 103 - DNA, 20 bp, Artificial sequence
  Synthetic oligonucleotide
ccaatgctctagagtgactg

SEQ ID NO: 104 - DNA, 20 bp, Artificial sequence
  Synthetic oligonucleotide
gcaaccgaaactgttgccaa

SEQ ID NO: 105 - DNA, 20 bp, Artificial sequence
  Synthetic oligonucleotide
ctccccgttacataatggag

SEQ ID NO: 106 - DNA, 20 bp, Artificial sequence
  Synthetic oligonucleotide
ccgcctgcgggtgccatcgc

SEQ ID NO: 107 - DNA, 20 bp, Artificial sequence
  Synthetic oligonucleotide
agttgataccgcctgcgggt

SEQ ID NO: 108 - DNA, 20 bp, Artificial sequence
  Synthetic oligonucleotide
cttgcatcagttgataccgc

SEQ ID NO: 109 - DNA, 20 bp, Artificial sequence
  Synthetic oligonucleotide
ggccgggaatgagtcaccgg

SEQ ID NO: 110 - DNA, 20 bp, Artificial sequence
  Synthetic oligonucleotide
gcgggcggccggccgaggtt

SEQ ID NO: 111 - DNA, 20 bp, Artificial sequence
  Synthetic oligonucleotide
cgcggcccggcgcacactct

SEQ ID NO: 112 - DNA, 20 bp, Artificial sequence
  Synthetic oligonucleotide
gaccaattgccgcgcggccc

SEQ ID NO: 113 - DNA, 20 bp, Artificial sequence
  Synthetic oligonucleotide
ggaggacaggcgacgcgcgg

SEQ ID NO: 114 - DNA, 20 bp, Artificial sequence
  Synthetic oligonucleotide
tcagcgactggctcggagga

SEQ ID NO: 115 - DNA, 20 bp, Artificial sequence
  Synthetic oligonucleotide
cgccataatgactgctctgc

SEQ ID NO: 116 - DNA, 20 bp, Artificial sequence
  Synthetic oligonucleotide
ccaaggttcgccataatgac

SEQ ID NO: 117 - DNA, 20 bp, Artificial sequence
  Synthetic oligonucleotide
ggtatcggctgcccccagtg

SEQ ID NO: 118 - DNA, 20 bp, Artificial sequence
  Synthetic oligonucleotide
tgccccgggtatcggctgcc

SEQ ID NO: 119 - DNA, 20 bp, Artificial sequence
  Synthetic oligonucleotide
gtgggtagcggttgcctcca

SEQ ID NO: 120 - DNA, 20 bp, Artificial sequence
  Synthetic oligonucleotide
ccaccgccctgaggtgggta

SEQ ID NO: 121 - DNA, 20 bp, Artificial sequence
  Synthetic oligonucleotide
ttggcttactcggcttgttc

SEQ ID NO: 122 - DNA, 20 bp, Artificial sequence
  Synthetic oligonucleotide
agcatgtagccgccaaggcc

SEQ ID NO: 123 - DNA, 20 bp, Artificial sequence
  Synthetic oligonucleotide
tgtatgatgggcctgctcat

SEQ ID NO: 124 - DNA, 20 bp, Artificial sequence
  Synthetic oligonucleotide
ggtcctcatagtcactgccg

SEQ ID NO: 125 - DNA, 20 bp, Artificial sequence
  Synthetic oligonucleotide
acggtgcatgttttcacgat

SEQ ID NO: 126 - DNA, 20 bp, Artificial sequence
  Synthetic oligonucleotide
gggcctgtagtacacttggt

SEQ ID NO: 127 - DNA, 20 bp, Artificial sequence
  Synthetic oligonucleotide
cgtgcacaaagttgttctgg

SEQ ID NO: 128 - DNA, 20 bp, Artificial sequence
  Synthetic oligonucleotide
gtggtgaccgtgtgctgctt

SEQ ID NO: 129 - DNA, 20 bp, Artificial sequence
  Synthetic oligonucleotide
cggtgaagttctcccccttg

SEQ ID NO: 130 - DNA, 20 bp, Artificial sequence
  Synthetic oligonucleotide
cgtcggtctcggtgaagttc

SEQ ID NO: 131 - DNA, 20 bp, Artificial sequence
  Synthetic oligonucleotide
tctgctcaaccacgcgctcc

SEQ ID NO: 132 - DNA, 20 bp, Artificial sequence
  Synthetic oligonucleotide
tgctcgatcctctctggtaa

SEQ ID NO: 133 - DNA, 20 bp, Artificial sequence
  Synthetic oligonucleotide
gataccgcctccctcaagct

SEQ ID NO: 134 - DNA, 20 bp, Artificial sequence
  Synthetic oligonucleotide
caggtggataccgcctccct

SEQ ID NO: 135 - DNA, 20 bp, Artificial sequence
  Synthetic oligonucleotide
ccaagggtattgattagcct

SEQ ID NO: 136 - DNA, 20 bp, Artificial sequence
  Synthetic oligonucleotide
gcattagcaacggctcatga

SEQ ID NO: 137 - DNA, 20 bp, Artificial sequence
  Synthetic oligonucleotide
ctggcctggcattagcaacg

SEQ ID NO: 138 - DNA, 20 bp, Artificial sequence
  Synthetic oligonucleotide
tcaacctgttgcactaagtc

SEQ ID NO: 139 - DNA, 20 bp, Artificial sequence
  Synthetic oligonucleotide
ggcattagtatactgagctc

SEQ ID NO: 140 - DNA, 20 bp, Artificial sequence
  Synthetic oligonucleotide
gtatcatgtggcctcctaac

SEQ ID NO: 141 - DNA, 20 bp, Artificial sequence
  Synthetic oligonucleotide
gttctcggtacacacagagc

SEQ ID NO: 142 - DNA, 20 bp, Artificial sequence
  Synthetic oligonucleotide
ctagccagaggttcagtgtt

SEQ ID NO: 143 - DNA, 20 bp, Artificial sequence
  Synthetic oligonucleotide
atgccacatatagggtcctt

SEQ ID NO: 144 - DNA, 20 bp, Artificial sequence
  Synthetic oligonucleotide
ccacgcaaaagggtttccca

SEQ ID NO: 145 - DNA, 20 bp, Artificial sequence
  Synthetic oligonucleotide
agtgcacattgtaagcctaa

SEQ ID NO: 146 - DNA, 20 bp, Artificial sequence
  Synthetic oligonucleotide
tcctcactcggcccccgcgg

SEQ ID NO: 147 - DNA, 20 bp, Artificial sequence
  Synthetic oligonucleotide
ccggccgggcacccttgcgc

SEQ ID NO: 148 - DNA, 20 bp, Artificial sequence
  Synthetic oligonucleotide
cacccgagcggagaccagcg

SEQ ID NO: 149 - DNA, 20 bp, Artificial sequence
  Synthetic oligonucleotide
ccaagccgcctcacccgagc

SEQ ID NO: 150 - DNA, 20 bp, Artificial sequence
  Synthetic oligonucleotide
ccaccgacctccctaacggg

SEQ ID NO: 151 - DNA, 20 bp, Artificial sequence
  Synthetic oligonucleotide
gcgatcgcccgctgggccgg

SEQ ID NO: 152 - DNA, 20 bp, Artificial sequence
  Synthetic oligonucleotide
cggccctcccggagttccct

SEQ ID NO: 153 - DNA, 20 bp, Artificial sequence
  Synthetic oligonucleotide
ttctgggccccgatctcggc

SEQ ID NO: 154 - DNA, 20 bp, Artificial sequence
  Synthetic oligonucleotide
cccggaactcccccggcggg

SEQ ID NO: 155 - DNA, 20 bp, Artificial sequence
  Synthetic oligonucleotide
gcaccgaggctcccggaact

SEQ ID NO: 156 - DNA, 20 bp, Artificial sequence
  Synthetic oligonucleotide
ggtggcaacggccgcaaggc

SEQ ID NO: 157 - DNA, 20 bp, Artificial sequence
  Synthetic oligonucleotide
tggttgttccttggagcccc

SEQ ID NO: 158 - DNA, 20 bp, Artificial sequence
  Synthetic oligonucleotide
tgtgaccgtggtggaattgc

SEQ ID NO: 159 - DNA, 20 bp, Artificial sequence
  Synthetic oligonucleotide
ggtgtggaagacttgtgtta

SEQ ID NO: 160 - DNA, 20 bp, Artificial sequence
  Synthetic oligonucleotide
gcatcaccagattgcttaac

SEQ ID NO: 161 - DNA, 20 bp, Artificial sequence
  Synthetic oligonucleotide
aggtgcagttaataacccac

SEQ ID NO: 162 - DNA, 20 bp, Artificial sequence
  Synthetic oligonucleotide
ggctagttggttgacagcca

SEQ ID NO: 163 - DNA, 20 bp, Artificial sequence
  Synthetic oligonucleotide
cccgtgatcaggcttcagtg

SEQ ID NO: 164 - DNA, 20 bp, Artificial sequence
  Synthetic oligonucleotide
cagtcagagagtgcctagcg

SEQ ID NO: 165 - DNA, 20 bp, Artificial sequence
  Synthetic oligonucleotide
agcttaattagttacatcgg

SEQ ID NO: 166 - DNA, 20 bp, Artificial sequence
  Synthetic oligonucleotide
ccccgttcatcttattccca

SEQ ID NO: 167 - DNA, 20 bp, Artificial sequence
  Synthetic oligonucleotide
tctcttagatttttggacgg

SEQ ID NO: 168 - DNA, 20 bp, Artificial sequence
  Synthetic oligonucleotide
gtgggcacacttagccaccc

SEQ ID NO: 169 - DNA, 20 bp, Artificial sequence
  Synthetic oligonucleotide
ggtctgggacttccataacc

SEQ ID NO: 170 - DNA, 20 bp, Artificial sequence
  Synthetic oligonucleotide
ggtggactgctaagactagg

SEQ ID NO: 171 - DNA, 20 bp, Artificial sequence
  Synthetic oligonucleotide
agctatatataggtgaccca

SEQ ID NO: 172 - DNA, 20 bp, Artificial sequence
  Synthetic oligonucleotide
aagattcttgttcagcacga

SEQ ID NO: 173 - DNA, 20 bp, Artificial sequence
  Synthetic oligonucleotide
ccattgtcatgggactcaag

SEQ ID NO: 174 - DNA, 20 bp, Artificial sequence
  Synthetic oligonucleotide
tagtggcctagtcctctggc

SEQ ID NO: 175 - DNA, 20 bp, Artificial sequence
  Synthetic oligonucleotide
gagttaaggatctatgagct

SEQ ID NO: 176 - DNA, 20 bp, Artificial sequence
  Synthetic oligonucleotide
cgggagtgcaggctccttta

SEQ ID NO: 177 - DNA, 20 bp, Artificial sequence
  Synthetic oligonucleotide
cgtggccatactggctgggc

SEQ ID NO: 178 - DNA, 20 bp, Artificial sequence
  Synthetic oligonucleotide
ctcctcttaatatgcgggtc

SEQ ID NO: 179 - DNA, 20 bp, Artificial sequence
  Synthetic oligonucleotide
acatgaccatcttattcggt

SEQ ID NO: 180 - DNA, 20 bp, Artificial sequence
  Synthetic oligonucleotide
aactagggcaccatcccctc

SEQ ID NO: 181 - DNA, 20 bp, Artificial sequence
  Synthetic oligonucleotide
acagtacctgctgtacccta

SEQ ID NO: 182 - DNA, 20 bp, Artificial sequence
  Synthetic oligonucleotide
ccagctccccgttacataat

SEQ ID NO: 183 - DNA, 20 bp, Artificial sequence
  Synthetic oligonucleotide
accgcctgcgggtgccatcg

SEQ ID NO: 184 - DNA, 20 bp, Artificial sequence
  Synthetic oligonucleotide
cagttgataccgcctgcggg

SEQ ID NO: 185 - DNA, 20 bp, Artificial sequence
  Synthetic oligonucleotide
acttgcatcagttgataccg

SEQ ID NO: 186 - DNA, 20 bp, Artificial sequence
  Synthetic oligonucleotide
cgaggtttaagttaaagggt

SEQ ID NO: 187 - DNA, 20 bp, Artificial sequence
  Synthetic oligonucleotide
tctgtgcccccggcgggcgg

SEQ ID NO: 188 - DNA, 20 bp, Artificial sequence
  Synthetic oligonucleotide
cgcgcggcccggcgcacact

SEQ ID NO: 189 - DNA, 20 bp, Artificial sequence
  Synthetic oligonucleotide
ggaccaattgccgcgcggcc

SEQ ID NO: 190 - DNA, 20 bp, Artificial sequence
  Synthetic oligonucleotide
cggaggacaggcgacgcgcg

SEQ ID NO: 191 - DNA, 20 bp, Artificial sequence
  Synthetic oligonucleotide
gctgtcagcgactggctcgg

SEQ ID NO: 192 - DNA, 20 bp, Artificial sequence
  Synthetic oligonucleotide
tcgccataatgactgctctg

SEQ ID NO: 193 - DNA, 20 bp, Artificial sequence
  Synthetic oligonucleotide
gcagccaaggttcgccataa

SEQ ID NO: 194 - DNA, 20 bp, Artificial sequence
  Synthetic oligonucleotide
gggtatcggctgcccccagt

SEQ ID NO: 195 - DNA, 20 bp, Artificial sequence
  Synthetic oligonucleotide
ccctgccccgggtatcggct

SEQ ID NO: 196 - DNA, 20 bp, Artificial sequence
  Synthetic oligonucleotide
ggtgggtagcggttgcctcc

SEQ ID NO: 197 - DNA, 20 bp, Artificial sequence
  Synthetic oligonucleotide
tactcggcttgttccactga

SEQ ID NO: 198 - DNA, 20 bp, Artificial sequence
  Synthetic oligonucleotide
gtttttggcttactcggctt

SEQ ID NO: 199 - DNA, 20 bp, Artificial sequence
  Synthetic oligonucleotide
cagcatgtagccgccaaggc

SEQ ID NO: 200 - DNA, 20 bp, Artificial sequence
  Synthetic oligonucleotide
atgtatgatgggcctgctca

SEQ ID NO: 201 - DNA, 20 bp, Artificial sequence
  Synthetic oligonucleotide
acgatagtaacggtcctcat

SEQ ID NO: 202 - DNA, 20 bp, Artificial sequence
  Synthetic oligonucleotide
aacggtgcatgttttcacga

SEQ ID NO: 203 - DNA, 20 bp, Artificial sequence
  Synthetic oligonucleotide
tgggcctgtagtacacttgg

SEQ ID NO: 204 - DNA, 20 bp, Artificial sequence
  Synthetic oligonucleotide
cgtgtgctgcttgattgtga

SEQ ID NO: 205 - DNA, 20 bp, Artificial sequence
  Synthetic oligonucleotide
tgtggtgaccgtgtgctgct

SEQ ID NO: 206 - DNA, 20 bp, Artificial sequence
  Synthetic oligonucleotide
tcggtgaagttctccccctt

SEQ ID NO: 207 - DNA, 20 bp, Artificial sequence
  Synthetic oligonucleotide
ccacgcgctccatcatctta

SEQ ID NO: 208 - DNA, 20 bp, Artificial sequence
  Synthetic oligonucleotide
acatctgctcaaccacgcgc

SEQ ID NO: 209 - DNA, 20 bp, Artificial sequence
  Synthetic oligonucleotide
atgctcgatcctctctggta

SEQ ID NO: 210 - DNA, 20 bp, Artificial sequence
  Synthetic oligonucleotide
ggataccgcctccctcaagc

SEQ ID NO: 211 - DNA, 20 bp, Artificial sequence
  Synthetic oligonucleotide
gctgcaggtggataccgcct

SEQ ID NO: 212 - DNA, 20 bp, Artificial sequence
  Synthetic oligonucleotide
gccaagggtattgattagcc

SEQ ID NO: 213 - DNA, 20 bp, Artificial sequence
  Synthetic oligonucleotide
ggcattagcaacggctcatg

SEQ ID NO: 214 - DNA, 20 bp, Artificial sequence
  Synthetic oligonucleotide
tttactggcctggcattagc

SEQ ID NO: 215 - DNA, 20 bp, Artificial sequence
  Synthetic oligonucleotide
ttagcctcaacctgttgcac

SEQ ID NO: 216 - DNA, 20 bp, Artificial sequence
  Synthetic oligonucleotide
gggcattagtatactgagct

SEQ ID NO: 217 - DNA, 20 bp, Artificial sequence
  Synthetic oligonucleotide
atgctccagcgggctgagcc

SEQ ID NO: 218 - DNA, 20 bp, Artificial sequence
  Synthetic oligonucleotide
cccagttctcggtacacaca

SEQ ID NO: 219 - DNA, 20 bp, Artificial sequence
  Synthetic oligonucleotide
tgtcctctagccagaggttc

SEQ ID NO: 220 - DNA, 20 bp, Artificial sequence
  Synthetic oligonucleotide
gaatgccacatatagggtcc

SEQ ID NO: 221 - DNA, 20 bp, Artificial sequence
  Synthetic oligonucleotide
accacgcaaaagggtttccc

SEQ ID NO: 222 - DNA, 20 bp, Artificial sequence
  Synthetic oligonucleotide
aacgattcagtgcacattgt

SEQ ID NO: 223 - DNA, 20 bp, Artificial sequence
  Synthetic oligonucleotide
gtcctcactcggcccccgcg

SEQ ID NO: 224 - DNA, 20 bp, Artificial sequence
  Synthetic oligonucleotide
cgcccggccgggcacccttg

SEQ ID NO: 225 - DNA, 20 bp, Artificial sequence
  Synthetic oligonucleotide
tcacccgagcggagaccagc

SEQ ID NO: 226 - DNA, 20 bp, Artificial sequence
  Synthetic oligonucleotide
aagccaagccgcctcacccg

SEQ ID NO: 227 - DNA, 20 bp, Artificial sequence
  Synthetic oligonucleotide
gcgctgagacaccccggcgc

SEQ ID NO: 228 - DNA, 20 bp, Artificial sequence
  Synthetic oligonucleotide
agcgatcgcccgctgggccg

SEQ ID NO: 229 - DNA, 20 bp, Artificial sequence
  Synthetic oligonucleotide
gcggccctcccggagttccc

SEQ ID NO: 230 - DNA, 20 bp, Artificial sequence
  Synthetic oligonucleotide
cgttctgggccccgatctcg

SEQ ID NO: 231 - DNA, 20 bp, Artificial sequence
  Synthetic oligonucleotide
tcccggaactcccccggcgg

SEQ ID NO: 232 - DNA, 20 bp, Artificial sequence
  Synthetic oligonucleotide
ccgcctcccgggaggaacgc

SEQ ID NO: 233 - DNA, 20 bp, Artificial sequence
  Synthetic oligonucleotide
ccaggcggtggcaacggccg

SEQ ID NO: 234 - DNA, 20 bp, Artificial sequence
  Synthetic oligonucleotide
ccgaggctggttgttccttg

SEQ ID NO: 235 - DNA, 20 bp, Artificial sequence
  Synthetic oligonucleotide
ggcgaggatggatgtgaccg

SEQ ID NO: 236 - DNA, 20 bp, Artificial sequence
  Synthetic oligonucleotide
tcggtgtggaagacttgtgt

SEQ ID NO: 237 - DNA, 20 bp, Artificial sequence
  Synthetic oligonucleotide
ggtgttatacatttaggctc

SEQ ID NO: 238 - DNA, 20 bp, Artificial sequence
  Synthetic oligonucleotide
gctaaactagatttgtgcct

SEQ ID NO: 239 - DNA, 20 bp, Artificial sequence
  Synthetic oligonucleotide
tggctagttggttgacagcc

SEQ ID NO: 240 - DNA, 20 bp, Artificial sequence
  Synthetic oligonucleotide
ggaattggcacccgtgatca

SEQ ID NO: 241 - DNA, 20 bp, Artificial sequence
  Synthetic oligonucleotide
ccagtcagagagtgcctagc

SEQ ID NO: 242 - DNA, 20 bp, Artificial sequence
  Synthetic oligonucleotide
cactaaagccttctagccca

SEQ ID NO: 243 - DNA, 20 bp, Artificial sequence
  Synthetic oligonucleotide
ggtgcacttgacctgccagg

SEQ ID NO: 244 - DNA, 20 bp, Artificial sequence
  Synthetic oligonucleotide
agtccctaaatcagctgtag

SEQ ID NO: 245 - DNA, 20 bp, Artificial sequence
  Synthetic oligonucleotide
ggtgggcacacttagccacc

SEQ ID NO: 246 - DNA, 20 bp, Artificial sequence
  Synthetic oligonucleotide
tgagagttgcccgggtctgg

SEQ ID NO: 247 - DNA, 20 bp, Artificial sequence
  Synthetic oligonucleotide
gatcaaatctgtggagcccc

SEQ ID NO: 248 - DNA, 20 bp, Artificial sequence
  Synthetic oligonucleotide
cagctatatataggtgaccc

SEQ ID NO: 249 - DNA, 20 bp, Artificial sequence
  Synthetic oligonucleotide
ttccatggtcttgatggcga

SEQ ID NO: 250 - DNA, 20 bp, Artificial sequence
  Synthetic oligonucleotide
ggtcaatacctgtttattac

SEQ ID NO: 251 - DNA, 20 bp, Artificial sequence
  Synthetic oligonucleotide
gtagtggcctagtcctctgg

SEQ ID NO: 252 - DNA, 20 bp, Artificial sequence
  Synthetic oligonucleotide
cgggctttgaatgtgcctca

SEQ ID NO: 253 - DNA, 20 bp, Artificial sequence
  Synthetic oligonucleotide
ggctaaagtttgctcagtgg

SEQ ID NO: 254 - DNA, 20 bp, Artificial sequence
  Synthetic oligonucleotide
agtgaggctcctttgtactc

SEQ ID NO: 255 - DNA, 20 bp, Artificial sequence
  Synthetic oligonucleotide
tctcctcttaatatgcgggt

SEQ ID NO: 256 - DNA, 20 bp, Artificial sequence
  Synthetic oligonucleotide
aacatgaccatcttattcgg

SEQ ID NO: 257 - DNA, 20 bp, Artificial sequence
  Synthetic oligonucleotide
gctactcatacaccccagga

SEQ ID NO: 258 - DNA, 20 bp, Artificial sequence
  Synthetic oligonucleotide
aacagtacctgctgtaccct

SEQ ID NO: 259 - DNA, 20 bp, Artificial sequence
  Synthetic oligonucleotide
tccagctccccgttacataa

SEQ ID NO: 260 - DNA, 20 bp, Artificial sequence
  Synthetic oligonucleotide
taccgcctgcgggtgccatc

SEQ ID NO: 261 - DNA, 20 bp, Artificial sequence
  Synthetic oligonucleotide
tcagttgataccgcctgcgg

SEQ ID NO: 262 - DNA, 20 bp, Artificial sequence
  Synthetic oligonucleotide
cacttgcatcagttgatacc

SEQ ID NO: 263 - DNA, 20 bp, Artificial sequence
  Synthetic oligonucleotide
ggccggccgaggtttaagtt

SEQ ID NO: 264 - DNA, 20 bp, Artificial sequence
  Synthetic oligonucleotide
cgcacactctgtgcccccgg

SEQ ID NO: 265 - DNA, 20 bp, Artificial sequence
  Synthetic oligonucleotide
tgccgcgcggcccggcgcac

SEQ ID NO: 266 - DNA, 20 bp, Artificial sequence
  Synthetic oligonucleotide
gggaccaattgccgcgcggc

SEQ ID NO: 267 - DNA, 20 bp, Artificial sequence
  Synthetic oligonucleotide
tcggaggacaggcgacgcgc

SEQ ID NO: 268 - DNA, 20 bp, Artificial sequence
  Synthetic oligonucleotide
cggctgtcagcgactggctc

SEQ ID NO: 269 - DNA, 20 bp, Artificial sequence
  Synthetic oligonucleotide
ttcgccataatgactgctct

SEQ ID NO: 270 - DNA, 20 bp, Artificial sequence
  Synthetic oligonucleotide
agcagccaaggttcgccata

SEQ ID NO: 271 - DNA, 20 bp, Artificial sequence
  Synthetic oligonucleotide
cgggtatcggctgcccccag

SEQ ID NO: 272 - DNA, 20 bp, Artificial sequence
  Synthetic oligonucleotide
gccctgccccgggtatcggc

SEQ ID NO: 273 - DNA, 20 bp, Artificial sequence
  Synthetic oligonucleotide
aggtgggtagcggttgcctc

SEQ ID NO: 274 - DNA, 20 bp, Artificial sequence
  Synthetic oligonucleotide
ttactcggcttgttccactg

SEQ ID NO: 275 - DNA, 20 bp, Artificial sequence
  Synthetic oligonucleotide
ggtttttggcttactcggct

SEQ ID NO: 276 - DNA, 20 bp, Artificial sequence
  Synthetic oligonucleotide
ccagcatgtagccgccaagg

SEQ ID NO: 277 - DNA, 20 bp, Artificial sequence
  Synthetic oligonucleotide
gccgaaatgtatgatgggcc

SEQ ID NO: 278 - DNA, 20 bp, Artificial sequence
  Synthetic oligonucleotide
cacgatagtaacggtcctca

SEQ ID NO: 279 - DNA, 20 bp, Artificial sequence
  Synthetic oligonucleotide
ggtaacggtgcatgttttca

SEQ ID NO: 280 - DNA, 20 bp, Artificial sequence
  Synthetic oligonucleotide
ccatgggcctgtagtacact

SEQ ID NO: 281 - DNA, 20 bp, Artificial sequence
  Synthetic oligonucleotide
ccgtgtgctgcttgattgtg

SEQ ID NO: 282 - DNA, 20 bp, Artificial sequence
  Synthetic oligonucleotide
ttgtggtgaccgtgtgctgc

SEQ ID NO: 283 - DNA, 20 bp, Artificial sequence
  Synthetic oligonucleotide
ctcggtgaagttctccccct

SEQ ID NO: 284 - DNA, 20 bp, Artificial sequence
  Synthetic oligonucleotide
aaccacgcgctccatcatct

SEQ ID NO: 285 - DNA, 20 bp, Artificial sequence
  Synthetic oligonucleotide
tacacatctgctcaaccacg

SEQ ID NO: 286 - DNA, 20 bp, Artificial sequence
  Synthetic oligonucleotide
gaggaccatgctcgatcctc

SEQ ID NO: 287 - DNA, 20 bp, Artificial sequence
  Synthetic oligonucleotide
tggataccgcctccctcaag

SEQ ID NO: 288 - DNA, 20 bp, Artificial sequence
  Synthetic oligonucleotide
gtattgattagcctatccgg

SEQ ID NO: 289 - DNA, 20 bp, Artificial sequence
  Synthetic oligonucleotide
tgccaagggtattgattagc

SEQ ID NO: 290 - DNA, 20 bp, Artificial sequence
  Synthetic oligonucleotide
tggcattagcaacggctcat

SEQ ID NO: 291 - DNA, 20 bp, Artificial sequence
  Synthetic oligonucleotide
gttatacttttactggcctg

SEQ ID NO: 292 - DNA, 20 bp, Artificial sequence
  Synthetic oligonucleotide
gtatactgagctctagctgc

SEQ ID NO: 293 - DNA, 20 bp, Artificial sequence
  Synthetic oligonucleotide
agggcattagtatactgagc

SEQ ID NO: 294 - DNA, 20 bp, Artificial sequence
  Synthetic oligonucleotide
catgctccagcgggctgagc

SEQ ID NO: 295 - DNA, 20 bp, Artificial sequence
  Synthetic oligonucleotide
acatcaccccagttctcggt

SEQ ID NO: 296 - DNA, 20 bp, Artificial sequence
  Synthetic oligonucleotide
gtgaatatgtcctctagcca

SEQ ID NO: 297 - DNA, 20 bp, Artificial sequence
  Synthetic oligonucleotide
ggaatgccacatatagggtc

SEQ ID NO: 298 - DNA, 20 bp, Artificial sequence
  Synthetic oligonucleotide
gtaagcctaaggaccacgca

SEQ ID NO: 299 - DNA, 20 bp, Artificial sequence
  Synthetic oligonucleotide
cctgttaatggtgtccactt

SEQ ID NO: 300 - DNA, 20 bp, Artificial sequence
  Synthetic oligonucleotide
ccttgcgcctgggacccgag

SEQ ID NO: 301 - DNA, 20 bp, Artificial sequence
  Synthetic oligonucleotide
ccgggcaggcccgagacgcg

SEQ ID NO: 302 - DNA, 20 bp, Artificial sequence
  Synthetic oligonucleotide
ctcacccgagcggagaccag

SEQ ID NO: 303 - DNA, 20 bp, Artificial sequence
  Synthetic oligonucleotide
cgaagccaagccgcctcacc

SEQ ID NO: 304 - DNA, 20 bp, Artificial sequence
  Synthetic oligonucleotide
ccgctgggccggacccgcgc

SEQ ID NO: 305 - DNA, 20 bp, Artificial sequence
  Synthetic oligonucleotide
ccagcgatcgcccgctgggc

SEQ ID NO: 306 - DNA, 20 bp, Artificial sequence
  Synthetic oligonucleotide
gctggcggccctcccggagt

SEQ ID NO: 307 - DNA, 20 bp, Artificial sequence
  Synthetic oligonucleotide
gcaccctctgggcatcgcgg

SEQ ID NO: 308 - DNA, 20 bp, Artificial sequence
  Synthetic oligonucleotide
ctcccggaactcccccggcg

SEQ ID NO: 309 - DNA, 20 bp, Artificial sequence
  Synthetic oligonucleotide
cctcggagaagctcaggcgg

SEQ ID NO: 310 - DNA, 20 bp, Artificial sequence
  Synthetic oligonucleotide
tctccaggcggtggcaacgg

SEQ ID NO: 311 - DNA, 20 bp, Artificial sequence
  Synthetic oligonucleotide
tccgaggctggttgttcctt

SEQ ID NO: 312 - DNA, 20 bp, Artificial sequence
  Synthetic oligonucleotide
gctgtggctctgcgatggcg

SEQ ID NO: 313 - DNA, 20 bp, Artificial sequence
  Synthetic oligonucleotide
gcaaccttccagcaagggtt

SEQ ID NO: 314 - DNA, 20 bp, Artificial sequence
  Synthetic oligonucleotide
ctggtgttatacatttaggc

SEQ ID NO: 315 - DNA, 20 bp, Artificial sequence
  Synthetic oligonucleotide
acaatctgttgtggttcagc

SEQ ID NO: 316 - DNA, 20 bp, Artificial sequence
  Synthetic oligonucleotide
gtttggctagttggttgaca

SEQ ID NO: 317 - DNA, 20 bp, Artificial sequence
  Synthetic oligonucleotide
tcagggaattggcacccgtg

SEQ ID NO: 318 - DNA, 20 bp, Artificial sequence
  Synthetic oligonucleotide
ggtccatgatcagaattacc

SEQ ID NO: 319 - DNA, 20 bp, Artificial sequence
  Synthetic oligonucleotide
gcactaaagccttctagccc

SEQ ID NO: 320 - DNA, 20 bp, Artificial sequence
  Synthetic oligonucleotide
agggtgcacttgacctgcca

SEQ ID NO: 321 - DNA, 20 bp, Artificial sequence
  Synthetic oligonucleotide
gagtccctaaatcagctgta

SEQ ID NO: 322 - DNA, 20 bp, Artificial sequence
  Synthetic oligonucleotide
gctagtacacaggtgggcac

SEQ ID NO: 323 - DNA, 20 bp, Artificial sequence
  Synthetic oligonucleotide
ggagtgagagttgcccgggt

SEQ ID NO: 324 - DNA, 20 bp, Artificial sequence
  Synthetic oligonucleotide
ggtgggcttaaggaccaaaa

SEQ ID NO: 325 - DNA, 20 bp, Artificial sequence
  Synthetic oligonucleotide
gatttggaacctgcatggct

SEQ ID NO: 326 - DNA, 20 bp, Artificial sequence
  Synthetic oligonucleotide
agcctacgaaaaccaacggc

SEQ ID NO: 327 - DNA, 20 bp, Artificial sequence
  Synthetic oligonucleotide
ggtaatggtcaatacctgtt

SEQ ID NO: 328 - DNA, 20 bp, Artificial sequence
  Synthetic oligonucleotide
aagtagtggcctagtcctct

SEQ ID NO: 329 - DNA, 20 bp, Artificial sequence
  Synthetic oligonucleotide
gagtcgggctttgaatgtgc

SEQ ID NO: 330 - DNA, 20 bp, Artificial sequence
  Synthetic oligonucleotide
ccatgtaacctggttcaggc

SEQ ID NO: 331 - DNA, 20 bp, Artificial sequence
  Synthetic oligonucleotide
cgggtcacatcatgccactt

SEQ ID NO: 332 - DNA, 20 bp, Artificial sequence
  Synthetic oligonucleotide
tcttattcggtgcttccatc

SEQ ID NO: 333 - DNA, 20 bp, Artificial sequence
  Synthetic oligonucleotide
atctcagtagctctaccttg

SEQ ID NO: 334 - DNA, 20 bp, Artificial sequence
  Synthetic oligonucleotide
ccctgatgtagtccccacaa

SEQ ID NO: 335 - DNA, 20 bp, Artificial sequence
  Synthetic oligonucleotide
gggcacttagctccaagagc

SEQ ID NO: 336 - DNA, 20 bp, Artificial sequence
  Synthetic oligonucleotide
tctttaattggaaattcggc

SEQ ID NO: 337 - DNA, 20 bp, Artificial sequence
  Synthetic oligonucleotide
ataccgcctgcgggtgccat

SEQ ID NO: 338 - DNA, 20 bp, Artificial sequence
  Synthetic oligonucleotide
catcagttgataccgcctgc

SEQ ID NO: 339 - DNA, 20 bp, Artificial sequence
  Synthetic oligonucleotide
gattcgcttgaacacttgca

SEQ ID NO: 340 - DNA, 20 bp, Artificial sequence
  Synthetic oligonucleotide
gcggccggccgaggtttaag

SEQ ID NO: 341 - DNA, 20 bp, Artificial sequence
  Synthetic oligonucleotide
cggcgcacactctgtgcccc

SEQ ID NO: 342 - DNA, 20 bp, Artificial sequence
  Synthetic oligonucleotide
attgccgcgcggcccggcgc

SEQ ID NO: 343 - DNA, 20 bp, Artificial sequence
  Synthetic oligonucleotide
gctcgcgggcggaggtcggc

SEQ ID NO: 344 - DNA, 20 bp, Artificial sequence
  Synthetic oligonucleotide
gctcggaggacaggcgacgc

SEQ ID NO: 345 - DNA, 20 bp, Artificial sequence
  Synthetic oligonucleotide
ccgcggctgtcagcgactgg

SEQ ID NO: 346 - DNA, 20 bp, Artificial sequence
  Synthetic oligonucleotide
gttcgccataatgactgctc

SEQ ID NO: 347 - DNA, 20 bp, Artificial sequence
  Synthetic oligonucleotide
tccagcagccaaggttcgcc

SEQ ID NO: 348 - DNA, 20 bp, Artificial sequence
  Synthetic oligonucleotide
ccgggtatcggctgccccca

SEQ ID NO: 349 - DNA, 20 bp, Artificial sequence
  Synthetic oligonucleotide
tgccctgccccgggtatcgg

SEQ ID NO: 350 - DNA, 20 bp, Artificial sequence
  Synthetic oligonucleotide
gaggtgggtagcggttgcct

SEQ ID NO: 351 - DNA, 20 bp, Artificial sequence
  Synthetic oligonucleotide
gcttactcggcttgttccac

SEQ ID NO: 352 - DNA, 20 bp, Artificial sequence
  Synthetic oligonucleotide
tggtttttggcttactcggc

SEQ ID NO: 353 - DNA, 20 bp, Artificial sequence
  Synthetic oligonucleotide
tcccagcatgtagccgccaa

SEQ ID NO: 354 - DNA, 20 bp, Artificial sequence
  Synthetic oligonucleotide
tgccgaaatgtatgatgggc

SEQ ID NO: 355 - DNA, 20 bp, Artificial sequence
  Synthetic oligonucleotide
tcacgatagtaacggtcctc

SEQ ID NO: 356 - DNA, 20 bp, Artificial sequence
  Synthetic oligonucleotide
gggtaacggtgcatgttttc

SEQ ID NO: 357 - DNA, 20 bp, Artificial sequence
  Synthetic oligonucleotide
atccatgggcctgtagtaca

SEQ ID NO: 358 - DNA, 20 bp, Artificial sequence
  Synthetic oligonucleotide
tgaccgtgtgctgcttgatt

SEQ ID NO: 359 - DNA, 20 bp, Artificial sequence
  Synthetic oligonucleotide
tggttgtggtgaccgtgtgc

SEQ ID NO: 360 - DNA, 20 bp, Artificial sequence
  Synthetic oligonucleotide
tctcggtgaagttctccccc

SEQ ID NO: 361 - DNA, 20 bp, Artificial sequence
  Synthetic oligonucleotide
ctcaaccacgcgctccatca

SEQ ID NO: 362 - DNA, 20 bp, Artificial sequence
  Synthetic oligonucleotide
gggtgatacacatctgctca

SEQ ID NO: 363 - DNA, 20 bp, Artificial sequence
  Synthetic oligonucleotide
aagaggaccatgctcgatcc

SEQ ID NO: 364 - DNA, 20 bp, Artificial sequence
  Synthetic oligonucleotide
gtggataccgcctccctcaa

SEQ ID NO: 365 - DNA, 20 bp, Artificial sequence
  Synthetic oligonucleotide
ggtattgattagcctatccg

SEQ ID NO: 366 - DNA, 20 bp, Artificial sequence
  Synthetic oligonucleotide
tcagtgccaagggtattgat

SEQ ID NO: 367 - DNA, 20 bp, Artificial sequence
  Synthetic oligonucleotide
ctggcattagcaacggctca

SEQ ID NO: 368 - DNA, 20 bp, Artificial sequence
  Synthetic oligonucleotide
gctgttatacttttactggc

SEQ ID NO: 369 - DNA, 20 bp, Artificial sequence
  Synthetic oligonucleotide
agtatactgagctctagctg

SEQ ID NO: 370 - DNA, 20 bp, Artificial sequence
  Synthetic oligonucleotide
tggcagaaatgttgtcgggt

SEQ ID NO: 371 - DNA, 20 bp, Artificial sequence
  Synthetic oligonucleotide
agagctcatgctccagcggg

SEQ ID NO: 372 - DNA, 20 bp, Artificial sequence
  Synthetic oligonucleotide
aacatcaccccagttctcgg

SEQ ID NO: 373 - DNA, 20 bp, Artificial sequence
  Synthetic oligonucleotide
ctaaaatgggaggttgcctc

SEQ ID NO: 374 - DNA, 20 bp, Artificial sequence
  Synthetic oligonucleotide
gctgccttaattacctatag

SEQ ID NO: 375 - DNA, 20 bp, Artificial sequence
  Synthetic oligonucleotide
tgtaagcctaaggaccacgc

SEQ ID NO: 376 - DNA, 20 bp, Artificial sequence
  Synthetic oligonucleotide
acctgttaatggtgtccact

SEQ ID NO: 377 - DNA, 20 bp, Artificial sequence
  Synthetic oligonucleotide
cccttgcgcctgggacccga

SEQ ID NO: 378 - DNA, 20 bp, Artificial sequence
  Synthetic oligonucleotide
gcggagaccagcgcagccgg

SEQ ID NO: 379 - DNA, 20 bp, Artificial sequence
  Synthetic oligonucleotide
cgcctcacccgagcggagac

SEQ ID NO: 380 - DNA, 20 bp, Artificial sequence
  Synthetic oligonucleotide
gcgaagccaagccgcctcac

SEQ ID NO: 381 - DNA, 20 bp, Artificial sequence
  Synthetic oligonucleotide
cccgctgggccggacccgcg

SEQ ID NO: 382 - DNA, 20 bp, Artificial sequence
  Synthetic oligonucleotide
gccagcgatcgcccgctggg

SEQ ID NO: 383 - DNA, 20 bp, Artificial sequence
  Synthetic oligonucleotide
ccctgcggagcccgctggcg

SEQ ID NO: 384 - DNA, 20 bp, Artificial sequence
  Synthetic oligonucleotide
aagcaccctctgggcatcgc

SEQ ID NO: 385 - DNA, 20 bp, Artificial sequence
  Synthetic oligonucleotide
cgaggctcccggaactcccc

SEQ ID NO: 386 - DNA, 20 bp, Artificial sequence
  Synthetic oligonucleotide
gcccccctcggagaagctca

SEQ ID NO: 387 - DNA, 20 bp, Artificial sequence
  Synthetic oligonucleotide
ggccgcttctccaggcggtg

SEQ ID NO: 388 - DNA, 20 bp, Artificial sequence
  Synthetic oligonucleotide
atccgaggctggttgttcct

SEQ ID NO: 389 - DNA, 20 bp, Artificial sequence
  Synthetic oligonucleotide
cggagagctgtggctctgcg

SEQ ID NO: 390 - DNA, 20 bp, Artificial sequence
  Synthetic oligonucleotide
ggcaaccttccagcaagggt

SEQ ID NO: 391 - DNA, 20 bp, Artificial sequence
  Synthetic oligonucleotide
ctactgccctggtgttatac

SEQ ID NO: 392 - DNA, 20 bp, Artificial sequence
  Synthetic oligonucleotide
atgcacccgagtggcctctg

SEQ ID NO: 393 - DNA, 20 bp, Artificial sequence
  Synthetic oligonucleotide
ggtttggctagttggttgac

SEQ ID NO: 394 - DNA, 20 bp, Artificial sequence
  Synthetic oligonucleotide
tctcagggaattggcacccg

SEQ ID NO: 395 - DNA, 20 bp, Artificial sequence
  Synthetic oligonucleotide
accccataatgtcccttgtc

SEQ ID NO: 396 - DNA, 20 bp, Artificial sequence
  Synthetic oligonucleotide
ggcactaaagccttctagcc

SEQ ID NO: 397 - DNA, 20 bp, Artificial sequence
  Synthetic oligonucleotide
aagggtgcacttgacctgcc

SEQ ID NO: 398 - DNA, 20 bp, Artificial sequence
  Synthetic oligonucleotide
gcattcccattaatgtggtg

SEQ ID NO: 399 - DNA, 20 bp, Artificial sequence
  Synthetic oligonucleotide
gtcttcacctgagatgtagt

SEQ ID NO: 400 - DNA, 20 bp, Artificial sequence
  Synthetic oligonucleotide
ggaggagtgagagttgcccg

SEQ ID NO: 401 - DNA, 20 bp, Artificial sequence
  Synthetic oligonucleotide
gatacttagcttggtgggct

SEQ ID NO: 402 - DNA, 20 bp, Artificial sequence
  Synthetic oligonucleotide
gcttatcaggatagcacaaa

SEQ ID NO: 403 - DNA, 20 bp, Artificial sequence
  Synthetic oligonucleotide
tgggactgaaggtcagccta

SEQ ID NO: 404 - DNA, 20 bp, Artificial sequence
  Synthetic oligonucleotide
gcctagtcctctggcatatt

SEQ ID NO: 405 - DNA, 20 bp, Artificial sequence
  Synthetic oligonucleotide
agtcaagtagtggcctagtc

SEQ ID NO: 406 - DNA, 20 bp, Artificial sequence
  Synthetic oligonucleotide
ggaatgacactgagtcgggc

SEQ ID NO: 407 - DNA, 20 bp, Artificial sequence
  Synthetic oligonucleotide
cccatgtaacctggttcagg

SEQ ID NO: 408 - DNA, 20 bp, Artificial sequence
  Synthetic oligonucleotide
tcttaatatgcgggtcacat

SEQ ID NO: 409 - DNA, 20 bp, Artificial sequence
  Synthetic oligonucleotide
atcttattcggtgcttccat

SEQ ID NO: 410 - DNA, 20 bp, Artificial sequence
  Synthetic oligonucleotide
gcatacattggatctatcag

SEQ ID NO: 411 - DNA, 20 bp, Artificial sequence
  Synthetic oligonucleotide
ggtcatgccagttagggttt

SEQ ID NO: 412 - DNA, 20 bp, Artificial sequence
  Synthetic oligonucleotide
ttaccctgggcacttagctc

SEQ ID NO: 413 - DNA, 20 bp, Artificial sequence
  Synthetic oligonucleotide
cgggtgccatcgctccctga

SEQ ID NO: 414 - DNA, 20 bp, Artificial sequence
  Synthetic oligonucleotide
gataccgcctgcgggtgcca

SEQ ID NO: 415 - DNA, 20 bp, Artificial sequence
  Synthetic oligonucleotide
gcatcagttgataccgcctg

SEQ ID NO: 416 - DNA, 20 bp, Artificial sequence
  Synthetic oligonucleotide
aacgagttgagattcgcttg

SEQ ID NO: 417 - DNA, 20 bp, Artificial sequence
  Synthetic oligonucleotide
ggcggccggccgaggtttaa

SEQ ID NO: 418 - DNA, 20 bp, Artificial sequence
  Synthetic oligonucleotide
ccggcgcacactctgtgccc

SEQ ID NO: 419 - DNA, 20 bp, Artificial sequence
  Synthetic oligonucleotide
caattgccgcgcggcccggc

SEQ ID NO: 420 - DNA, 20 bp, Artificial sequence
  Synthetic oligonucleotide
cgctcgcgggcggaggtcgg

SEQ ID NO: 421 - DNA, 20 bp, Artificial sequence
  Synthetic oligonucleotide
gcgactggctcggaggacag

SEQ ID NO: 422 - DNA, 20 bp, Artificial sequence
  Synthetic oligonucleotide
cgccgcggctgtcagcgact

SEQ ID NO: 423 - DNA, 20 bp, Artificial sequence
  Synthetic oligonucleotide
aggttcgccataatgactgc

SEQ ID NO: 424 - DNA, 20 bp, Artificial sequence
  Synthetic oligonucleotide
gcgcttcttgcagaggccca

SEQ ID NO: 425 - DNA, 20 bp, Artificial sequence
  Synthetic oligonucleotide
cccgggtatcggctgccccc

SEQ ID NO: 426 - DNA, 20 bp, Artificial sequence
  Synthetic oligonucleotide
gggtagcggttgcctccagg

SEQ ID NO: 427 - DNA, 20 bp, Artificial sequence
  Synthetic oligonucleotide
ccctgaggtgggtagcggtt

SEQ ID NO: 428 - DNA, 20 bp, Artificial sequence
  Synthetic oligonucleotide
ggcttactcggcttgttcca

SEQ ID NO: 429 - DNA, 20 bp, Artificial sequence
  Synthetic oligonucleotide
atgtagccgccaaggccccc

SEQ ID NO: 430 - DNA, 20 bp, Artificial sequence
  Synthetic oligonucleotide
cttcccagcatgtagccgcc

SEQ ID NO: 431 - DNA, 20 bp, Artificial sequence
  Synthetic oligonucleotide
tcctcatagtcactgccgaa

SEQ ID NO: 432 - DNA, 20 bp, Artificial sequence
  Synthetic oligonucleotide
ttcacgatagtaacggtcct

SEQ ID NO: 433 - DNA, 20 bp, Artificial sequence
  Synthetic oligonucleotide
ctgtagtacacttggttggg

SEQ ID NO: 434 - DNA, 20 bp, Artificial sequence
  Synthetic oligonucleotide
tactcatccatgggcctgta

SEQ ID NO: 435 - DNA, 20 bp, Artificial sequence
  Synthetic oligonucleotide
ggtgaccgtgtgctgcttga

SEQ ID NO: 436 - DNA, 20 bp, Artificial sequence
  Synthetic oligonucleotide
ctcccccttggtggttgtgg

SEQ ID NO: 437 - DNA, 20 bp, Artificial sequence
  Synthetic oligonucleotide
ggtctcggtgaagttctccc

SEQ ID NO: 438 - DNA, 20 bp, Artificial sequence
  Synthetic oligonucleotide
tgctcaaccacgcgctccat

SEQ ID NO: 439 - DNA, 20 bp, Artificial sequence
  Synthetic oligonucleotide
ggtaataggcctgagattcc

SEQ ID NO: 440 - DNA, 20 bp, Artificial sequence
  Synthetic oligonucleotide
ggagaagaggaccatgctcg

SEQ ID NO: 441 - DNA, 20 bp, Artificial sequence
  Synthetic oligonucleotide
ggtggataccgcctccctca

SEQ ID NO: 442 - DNA, 20 bp, Artificial sequence
  Synthetic oligonucleotide
gggtattgattagcctatcc

SEQ ID NO: 443 - DNA, 20 bp, Artificial sequence
  Synthetic oligonucleotide
gcaacggctcatgatgaact

SEQ ID NO: 444 - DNA, 20 bp, Artificial sequence
  Synthetic oligonucleotide
cctggcattagcaacggctc

SEQ ID NO: 445 - DNA, 20 bp, Artificial sequence
  Synthetic oligonucleotide
agtccagattaaccaatggt

SEQ ID NO: 446 - DNA, 20 bp, Artificial sequence
  Synthetic oligonucleotide
tagtatactgagctctagct

SEQ ID NO: 447 - DNA, 20 bp, Artificial sequence
  Synthetic oligonucleotide
cctggcagaaatgttgtcgg

SEQ ID NO: 448 - DNA, 20 bp, Artificial sequence
  Synthetic oligonucleotide
cggtacacacagagctcatg

SEQ ID NO: 449 - DNA, 20 bp, Artificial sequence
  Synthetic oligonucleotide
gtgtagcccatactgtgaaa

SEQ ID NO: 450 - DNA, 20 bp, Artificial sequence
  Synthetic oligonucleotide
agggtcctttaaacatctaa

SEQ ID NO: 451 - DNA, 20 bp, Artificial sequence
  Synthetic oligonucleotide
atcctctatgatgatggtgc

SEQ ID NO: 452 - DNA, 20 bp, Artificial sequence
  Synthetic oligonucleotide
ttgtaagcctaaggaccacg

SEQ ID NO: 453 - DNA, 20 bp, Artificial sequence
  Synthetic oligonucleotide
aagacctgttaatggtgtcc

SEQ ID NO: 454 - DNA, 20 bp, Artificial sequence
  Synthetic oligonucleotide
ggcacccttgcgcctgggac

SEQ ID NO: 455 - DNA, 20 bp, Artificial sequence
  Synthetic oligonucleotide
agcggagaccagcgcagccg

SEQ ID NO: 456 - DNA, 20 bp, Artificial sequence
  Synthetic oligonucleotide
ccgcctcacccgagcggaga

SEQ ID NO: 457 - DNA, 20 bp, Artificial sequence
  Synthetic oligonucleotide
aagcgaagccaagccgcctc

SEQ ID NO: 458 - DNA, 20 bp, Artificial sequence
  Synthetic oligonucleotide
tcgcccgctgggccggaccc

SEQ ID NO: 459 - DNA, 20 bp, Artificial sequence
  Synthetic oligonucleotide
tcccggagttccctgggcgc

SEQ ID NO: 460 - DNA, 20 bp, Artificial sequence
  Synthetic oligonucleotide
gcgccctgcggagcccgctg

SEQ ID NO: 461 - DNA, 20 bp, Artificial sequence
  Synthetic oligonucleotide
cggaactcccccggcgggcg

SEQ ID NO: 462 - DNA, 20 bp, Artificial sequence
  Synthetic oligonucleotide
ccgaggctcccggaactccc

SEQ ID NO: 463 - DNA, 20 bp, Artificial sequence
  Synthetic oligonucleotide
agcccccctcggagaagctc

SEQ ID NO: 464 - DNA, 20 bp, Artificial sequence
  Synthetic oligonucleotide
tgggccgcttctccaggcgg

SEQ ID NO: 465 - DNA, 20 bp, Artificial sequence
  Synthetic oligonucleotide
ggagaccggtgacccaaggg

SEQ ID NO: 466 - DNA, 20 bp, Artificial sequence
  Synthetic oligonucleotide
cgcggccatgaagatcctca

SEQ ID NO: 467 - DNA, 20 bp, Artificial sequence
  Synthetic oligonucleotide
gttttgggcaaccttccagc

SEQ ID NO: 468 - DNA, 20 bp, Artificial sequence
  Synthetic oligonucleotide
gtgcagttaataacccactt

SEQ ID NO: 469 - DNA, 20 bp, Artificial sequence
  Synthetic oligonucleotide
acagatgcacccgagtggcc

SEQ ID NO: 470 - DNA, 20 bp, Artificial sequence
  Synthetic oligonucleotide
gtggatatagttgccttgga

SEQ ID NO: 471 - DNA, 20 bp, Artificial sequence
  Synthetic oligonucleotide
ttctcagggaattggcaccc

SEQ ID NO: 472 - DNA, 20 bp, Artificial sequence
  Synthetic oligonucleotide
cgaccttcaccccataatgt

SEQ ID NO: 473 - DNA, 20 bp, Artificial sequence
  Synthetic oligonucleotide
aggcactaaagccttctagc

SEQ ID NO: 474 - DNA, 20 bp, Artificial sequence
  Synthetic oligonucleotide
gacttacacttcacttagac

SEQ ID NO: 475 - DNA, 20 bp, Artificial sequence
  Synthetic oligonucleotide
gctctattaataggttagga

SEQ ID NO: 476 - DNA, 20 bp, Artificial sequence
  Synthetic oligonucleotide
ggacaaactggtggagggtc

SEQ ID NO: 477 - DNA, 20 bp, Artificial sequence
  Synthetic oligonucleotide
ggagtccatgcagctagcag

SEQ ID NO: 478 - DNA, 20 bp, Artificial sequence
  Synthetic oligonucleotide
ggtgacccacaacacattat

SEQ ID NO: 479 - DNA, 20 bp, Artificial sequence
  Synthetic oligonucleotide
cgcttatcaggatagcacaa

SEQ ID NO: 480 - DNA, 20 bp, Artificial sequence
  Synthetic oligonucleotide
gcaattagtgtgatcatgca

SEQ ID NO: 481 - DNA, 20 bp, Artificial sequence
  Synthetic oligonucleotide
gtggcctagtcctctggcat

SEQ ID NO: 482 - DNA, 20 bp, Artificial sequence
  Synthetic oligonucleotide
gtcaccagtcaagtagtggc

SEQ ID NO: 483 - DNA, 20 bp, Artificial sequence
  Synthetic oligonucleotide
agggaatgacactgagtcgg

SEQ ID NO: 484 - DNA, 20 bp, Artificial sequence
  Synthetic oligonucleotide
gggccccatgtaacctggtt

SEQ ID NO: 485 - DNA, 20 bp, Artificial sequence
  Synthetic oligonucleotide
ctcttaatatgcgggtcaca

SEQ ID NO: 486 - DNA, 20 bp, Artificial sequence
  Synthetic oligonucleotide
ccatcttattcggtgcttcc

SEQ ID NO: 487 - DNA, 20 bp, Artificial sequence
  Synthetic oligonucleotide
ccagcatacattggatctat

SEQ ID NO: 488 - DNA, 20 bp, Artificial sequence
  Synthetic oligonucleotide
gtactcaggtcatgccagtt

SEQ ID NO: 489 - DNA, 20 bp, Artificial sequence
  Synthetic oligonucleotide
gagtcccatatttatgttga

SEQ ID NO: 490 - DNA, 20 bp, Artificial sequence
  Synthetic oligonucleotide
tggaaattcggcccaaagct

SEQ ID NO: 491 - DNA, 20 bp, Artificial sequence
  Synthetic oligonucleotide
gtggctcattgactgtaaaa

SEQ ID NO: 492 - DNA, 20 bp, Artificial sequence
  Synthetic oligonucleotide
caccggaaaaaacgagttga

SEQ ID NO: 493 - DNA, 20 bp, Artificial sequence
  Synthetic oligonucleotide
ccccagccaccaccatgagg

SEQ ID NO: 494 - DNA, 20 bp, Artificial sequence
  Synthetic oligonucleotide
tgcttcatgttggtttttgg

SEQ ID NO: 495 - DNA, 20 bp, Artificial sequence
  Synthetic oligonucleotide
gaagaccttcctcatcccac

SEQ ID NO: 496 - DNA, 20 bp, Artificial sequence
  Synthetic oligonucleotide
ttgaccagcatctcaggtct

SEQ ID NO: 497 - DNA, 20 bp, Artificial sequence
  Synthetic oligonucleotide
ctgttctgagatttgtttta

SEQ ID NO: 498 - DNA, 20 bp, Artificial sequence
  Synthetic oligonucleotide
atcatgtggcctcctaacaa

SEQ ID NO: 499 - DNA, 20 bp, Artificial sequence
  Synthetic oligonucleotide
actcttgttgaacagctgct

SEQ ID NO: 500 - DNA, 20 bp, Artificial sequence
  Synthetic oligonucleotide
gccagaggttcagtgttgtg

SEQ ID NO: 501 - DNA, 20 bp, Artificial sequence
  Synthetic oligonucleotide
tttcatatatgttacagtta

SEQ ID NO: 502 - DNA, 20 bp, Artificial sequence
  Synthetic oligonucleotide
ccattcccaaacatttgatt

SEQ ID NO: 503 - DNA, 20 bp, Artificial sequence
  Synthetic oligonucleotide
ccttaattacctatagttta

SEQ ID NO: 504 - DNA, 20 bp, Artificial sequence
  Synthetic oligonucleotide
ccttcagtgtctagaaggca

SEQ ID NO: 505 - DNA, 20 bp, Artificial sequence
  Synthetic oligonucleotide
tgtatgtcaaaatcattctg

SEQ ID NO: 506 - DNA, 20 bp, Artificial sequence
  Synthetic oligonucleotide
ctatgatgatggtgctttca

SEQ ID NO: 507 - DNA, 20 bp, Artificial sequence
  Synthetic oligonucleotide
acactgaccattttttaatt

SEQ ID NO: 508 - DNA, 20 bp, Artificial sequence
  Synthetic oligonucleotide
aagaaatgcaagcagttctt

SEQ ID NO: 509 - DNA, 20 bp, Artificial sequence
  Synthetic oligonucleotide
caattacagaaactatgaac

SEQ ID NO: 510 - DNA, 20 bp, Artificial sequence
  Synthetic oligonucleotide
agattgtctccctattcttt

SEQ ID NO: 511 - DNA, 20 bp, Artificial sequence
  Synthetic oligonucleotide
tatttctgtcatctccaacc

SEQ ID NO: 512 - DNA, 20 bp, Artificial sequence
  Synthetic oligonucleotide
tctttttccacttcaaatca

SEQ ID NO: 513 - DNA, 20 bp, Artificial sequence
  Synthetic oligonucleotide
aacaattcagggaataattt

SEQ ID NO: 514 - DNA, 20 bp, Artificial sequence
  Synthetic oligonucleotide
gcagaaaagtaatacatatc

SEQ ID NO: 515 - DNA, 20 bp, Artificial sequence
  Synthetic oligonucleotide
actgctctaaacaaaactcc

SEQ ID NO: 516 - DNA, 20 bp, Artificial sequence
  Synthetic oligonucleotide
catattaagtattcagtacc

SEQ ID NO: 517 - DNA, 20 bp, Artificial sequence
  Synthetic oligonucleotide
acaagaacatgcaaagttac

SEQ ID NO: 518 - DNA, 20 bp, Artificial sequence
  Synthetic oligonucleotide
catgaagatcctcatcatta

SEQ ID NO: 519 - DNA, 20 bp, Artificial sequence
  Synthetic oligonucleotide
ctaccaggagttttccctaa

SEQ ID NO: 520 - DNA, 20 bp, Artificial sequence
  Synthetic oligonucleotide
ttttgataattatatttgta

SEQ ID NO: 521 - DNA, 20 bp, Artificial sequence
  Synthetic oligonucleotide
ccagaagtttaacatattta

SEQ ID NO: 522 - DNA, 20 bp, Artificial sequence
  Synthetic oligonucleotide
aaaattgctcctttccactg

SEQ ID NO: 523 - DNA, 20 bp, Artificial sequence
  Synthetic oligonucleotide
tactggttagctttttttca

SEQ ID NO: 524 - DNA, 20 bp, Artificial sequence
  Synthetic oligonucleotide
tggaagacttgtgttagata

SEQ ID NO: 525 - DNA, 20 bp, Artificial sequence
  Synthetic oligonucleotide
tttgccatttatctattata

SEQ ID NO: 526 - DNA, 20 bp, Artificial sequence
  Synthetic oligonucleotide
caaacatgctctaatttgca

SEQ ID NO: 527 - DNA, 20 bp, Artificial sequence
  Synthetic oligonucleotide
tgcagaaccatctttgtgac

SEQ ID NO: 528 - DNA, 20 bp, Artificial sequence
  Synthetic oligonucleotide
caataactcatacatacaga

SEQ ID NO: 529 - DNA, 20 bp, Artificial sequence
  Synthetic oligonucleotide
gcaggtaagttctcaggagt

SEQ ID NO: 530 - DNA, 20 bp, Artificial sequence
  Synthetic oligonucleotide
tgtcataattttcttagcta

SEQ ID NO: 531 - DNA, 20 bp, Artificial sequence
  Synthetic oligonucleotide
ggctccaaaatcatgatttt

SEQ ID NO: 532 - DNA, 20 bp, Artificial sequence
  Synthetic oligonucleotide
taataacccacttttttact

SEQ ID NO: 533 - DNA, 20 bp, Artificial sequence
  Synthetic oligonucleotide
accaaaggaaaattaagatc

SEQ ID NO: 534 - DNA, 20 bp, Artificial sequence
  Synthetic oligonucleotide
gctaaaaatcttttattcta

SEQ ID NO: 535 - DNA, 20 bp, Artificial sequence
  Synthetic oligonucleotide
tgaccctcattttctgtgac

SEQ ID NO: 536 - DNA, 20 bp, Artificial sequence
  Synthetic oligonucleotide
taattctaaaaatctgtggc

SEQ ID NO: 537 - DNA, 20 bp, Artificial sequence
  Synthetic oligonucleotide
cagaaacttctgttatgtta

SEQ ID NO: 538 - DNA, 20 bp, Artificial sequence
  Synthetic oligonucleotide
tgggttagatacagacatgt

SEQ ID NO: 539 - DNA, 20 bp, Artificial sequence
  Synthetic oligonucleotide
aggattacctcccttaaagt

SEQ ID NO: 540 - DNA, 20 bp, Artificial sequence
  Synthetic oligonucleotide
agtaaattcccttgttatat

SEQ ID NO: 541 - DNA, 20 bp, Artificial sequence
  Synthetic oligonucleotide
cattatgaaattatactcaa

SEQ ID NO: 542 - DNA, 20 bp, Artificial sequence
  Synthetic oligonucleotide
ctatctttctatttgtgtct

SEQ ID NO: 543 - DNA, 20 bp, Artificial sequence
  Synthetic oligonucleotide
ttagatctgaaacgagacaa

SEQ ID NO: 544 - DNA, 20 bp, Artificial sequence
  Synthetic oligonucleotide
gaagcaaattcaacagctca

SEQ ID NO: 545 - DNA, 20 bp, Artificial sequence
  Synthetic oligonucleotide
catcagacttacacttcact

SEQ ID NO: 546 - DNA, 20 bp, Artificial sequence
  Synthetic oligonucleotide
ggtggtagtttttcaaatca

SEQ ID NO: 547 - DNA, 20 bp, Artificial sequence
  Synthetic oligonucleotide
ggatagtctctttccatcat

SEQ ID NO: 548 - DNA, 20 bp, Artificial sequence
  Synthetic oligonucleotide
agggtcaaaattcaatgcta

SEQ ID NO: 549 - DNA, 20 bp, Artificial sequence
  Synthetic oligonucleotide
acacagttttgaataagata

SEQ ID NO: 550 - DNA, 20 bp, Artificial sequence
  Synthetic oligonucleotide
cattattgtgccaccaagcc

SEQ ID NO: 551 - DNA, 20 bp, Artificial sequence
  Synthetic oligonucleotide
ttctttgcagggatatgcaa

SEQ ID NO: 552 - DNA, 20 bp, Artificial sequence
  Synthetic oligonucleotide
atgcacatagaaaatccaac

SEQ ID NO: 553 - DNA, 20 bp, Artificial sequence
  Synthetic oligonucleotide
ctggcatatttcaagatatc

SEQ ID NO: 554 - DNA, 20 bp, Artificial sequence
  Synthetic oligonucleotide
tagtatttttgacaatggcc

SEQ ID NO: 555 - DNA, 20 bp, Artificial sequence
  Synthetic oligonucleotide
tgcttattattcatgttctc

SEQ ID NO: 556 - DNA, 20 bp, Artificial sequence
  Synthetic oligonucleotide
atgccacttcccttgtccct

SEQ ID NO: 557 - DNA, 20 bp, Artificial sequence
  Synthetic oligonucleotide
gaattttctctcccagcata

SEQ ID NO: 558 - DNA, 20 bp, Artificial sequence
  Synthetic oligonucleotide
ttgaaagttacaagcagagt

SEQ ID NO: 559 - DNA, 20 bp, Artificial sequence
  Synthetic oligonucleotide
aactggataatattcataaa

SEQ ID NO: 560 - DNA, 20 bp, Artificial sequence
  Synthetic oligonucleotide
cctttatcacccaattagct

SEQ ID NO: 561 - DNA, 20 bp, Artificial sequence
  Synthetic oligonucleotide
ttttagtacatttaatgaaa

SEQ ID NO: 562 - DNA, 20 bp, Artificial sequence
  Synthetic oligonucleotide
tataatggcatatactggaa

SEQ ID NO: 563 - DNA, 20 bp, Artificial sequence
  Synthetic oligonucleotide
aaacagtacctgctgtaccc

SEQ ID NO: 564 - DNA, 20 bp, Artificial sequence
  Synthetic oligonucleotide
aatctcttttcaaattaaag

SEQ ID NO: 565 - DNA, 20 bp, Artificial sequence
  Synthetic oligonucleotide
cctttggagaatgtacattc

SEQ ID NO: 566 - DNA, 20 bp, Artificial sequence
  Synthetic oligonucleotide
ttctaatttttgtaccaaaa

SEQ ID NO: 567 - DNA, 20 bp, Artificial sequence
  Synthetic oligonucleotide
ttggaaattcggcccaaagc

SEQ ID NO: 568 - DNA, 20 bp, Artificial sequence
  Synthetic oligonucleotide
cgtggctcattgactgtaaa

SEQ ID NO: 569 - DNA, 20 bp, Artificial sequence
  Synthetic oligonucleotide
gtcaccggaaaaaacgagtt

SEQ ID NO: 570 - DNA, 20 bp, Artificial sequence
  Synthetic oligonucleotide
cccccagccaccaccatgag

SEQ ID NO: 571 - DNA, 20 bp, Artificial sequence
  Synthetic oligonucleotide
ccatgtgcttcatgttggtt

SEQ ID NO: 572 - DNA, 20 bp, Artificial sequence
  Synthetic oligonucleotide
ggaagaccttcctcatccca

SEQ ID NO: 573 - DNA, 20 bp, Artificial sequence
  Synthetic oligonucleotide
cttgaccagcatctcaggtc

SEQ ID NO: 574 - DNA, 20 bp, Artificial sequence
  Synthetic oligonucleotide
ggcaaaggtatttcagactg

SEQ ID NO: 575 - DNA, 20 bp, Artificial sequence
  Synthetic oligonucleotide
tatcatgtggcctcctaaca

SEQ ID NO: 576 - DNA, 20 bp, Artificial sequence
  Synthetic oligonucleotide
tactcttgttgaacagctgc

SEQ ID NO: 577 - DNA, 20 bp, Artificial sequence
  Synthetic oligonucleotide
tgaatatgtcctctagccag

SEQ ID NO: 578 - DNA, 20 bp, Artificial sequence
  Synthetic oligonucleotide
ctttcatatatgttacagtt

SEQ ID NO: 579 - DNA, 20 bp, Artificial sequence
  Synthetic oligonucleotide
accattcccaaacatttgat

SEQ ID NO: 580 - DNA, 20 bp, Artificial sequence
  Synthetic oligonucleotide
gccttaattacctatagttt

SEQ ID NO: 581 - DNA, 20 bp, Artificial sequence
  Synthetic oligonucleotide
gccttcagtgtctagaaggc

SEQ ID NO: 582 - DNA, 20 bp, Artificial sequence
  Synthetic oligonucleotide
ctgtatgtcaaaatcattct

SEQ ID NO: 583 - DNA, 20 bp, Artificial sequence
  Synthetic oligonucleotide
ctctatgatgatggtgcttt

SEQ ID NO: 584 - DNA, 20 bp, Artificial sequence
  Synthetic oligonucleotide
gcacactgaccattttttaa

SEQ ID NO: 585 - DNA, 20 bp, Artificial sequence
  Synthetic oligonucleotide
ataaagaaatgcaagcagtt

SEQ ID NO: 586 - DNA, 20 bp, Artificial sequence
  Synthetic oligonucleotide
ccaattacagaaactatgaa

SEQ ID NO: 587 - DNA, 20 bp, Artificial sequence
  Synthetic oligonucleotide
tagattgtctccctattctt

SEQ ID NO: 588 - DNA, 20 bp, Artificial sequence
  Synthetic oligonucleotide
atatttctgtcatctccaac

SEQ ID NO: 589 - DNA, 20 bp, Artificial sequence
  Synthetic oligonucleotide
aatttctttttccacttcaa

SEQ ID NO: 590 - DNA, 20 bp, Artificial sequence
  Synthetic oligonucleotide
tatcaaacaattcagggaat

SEQ ID NO: 591 - DNA, 20 bp, Artificial sequence
  Synthetic oligonucleotide
cattgcagaaaagtaataca

SEQ ID NO: 592 - DNA, 20 bp, Artificial sequence
  Synthetic oligonucleotide
taactgctctaaacaaaact

SEQ ID NO: 593 - DNA, 20 bp, Artificial sequence
  Synthetic oligonucleotide
gtttcccacatattaagtat

SEQ ID NO: 594 - DNA, 20 bp, Artificial sequence
  Synthetic oligonucleotide
aacaaaacaagaacatgcaa

SEQ ID NO: 595 - DNA, 20 bp, Artificial sequence
  Synthetic oligonucleotide
ccatgaagatcctcatcatt

SEQ ID NO: 596 - DNA, 20 bp, Artificial sequence
  Synthetic oligonucleotide
tctaccaggagttttcccta

SEQ ID NO: 597 - DNA, 20 bp, Artificial sequence
  Synthetic oligonucleotide
cctatgtttttgataattat

SEQ ID NO: 598 - DNA, 20 bp, Artificial sequence
  Synthetic oligonucleotide
tccagaagtttaacatattt

SEQ ID NO: 599 - DNA, 20 bp, Artificial sequence
  Synthetic oligonucleotide
taaaattgctcctttccact

SEQ ID NO: 600 - DNA, 20 bp, Artificial sequence
  Synthetic oligonucleotide
gcttttccccttactggtta

SEQ ID NO: 601 - DNA, 20 bp, Artificial sequence
  Synthetic oligonucleotide
gtggaagacttgtgttagat

SEQ ID NO: 602 - DNA, 20 bp, Artificial sequence
  Synthetic oligonucleotide
attttgccatttatctatta

SEQ ID NO: 603 - DNA, 20 bp, Artificial sequence
  Synthetic oligonucleotide
tgataacccaaacatgctct

SEQ ID NO: 604 - DNA, 20 bp, Artificial sequence
  Synthetic oligonucleotide
ctgcagaaccatctttgtga

SEQ ID NO: 605 - DNA, 20 bp, Artificial sequence
  Synthetic oligonucleotide
cccaataactcatacataca

SEQ ID NO: 606 - DNA, 20 bp, Artificial sequence
  Synthetic oligonucleotide
ttgcaggtaagttctcagga

SEQ ID NO: 607 - DNA, 20 bp, Artificial sequence
  Synthetic oligonucleotide
tgtgtcataattttcttagc

SEQ ID NO: 608 - DNA, 20 bp, Artificial sequence
  Synthetic oligonucleotide
caggctccaaaatcatgatt

SEQ ID NO: 609 - DNA, 20 bp, Artificial sequence
  Synthetic oligonucleotide
gttaataacccactttttta

SEQ ID NO: 610 - DNA, 20 bp, Artificial sequence
  Synthetic oligonucleotide
gcaatatattcaccaaagga

SEQ ID NO: 611 - DNA, 20 bp, Artificial sequence
  Synthetic oligonucleotide
ggctaaaaatcttttattct

SEQ ID NO: 612 - DNA, 20 bp, Artificial sequence
  Synthetic oligonucleotide
cctgaccctcattttctgtg

SEQ ID NO: 613 - DNA, 20 bp, Artificial sequence
  Synthetic oligonucleotide
cataattctaaaaatctgtg

SEQ ID NO: 614 - DNA, 20 bp, Artificial sequence
  Synthetic oligonucleotide
gcagaaacttctgttatgtt

SEQ ID NO: 615 - DNA, 20 bp, Artificial sequence
  Synthetic oligonucleotide
tagccatcactgggttagat

SEQ ID NO: 616 - DNA, 20 bp, Artificial sequence
  Synthetic oligonucleotide
gaaggattacctcccttaaa

SEQ ID NO: 617 - DNA, 20 bp, Artificial sequence
  Synthetic oligonucleotide
gctaagtaaattcccttgtt

SEQ ID NO: 618 - DNA, 20 bp, Artificial sequence
  Synthetic oligonucleotide
acattatgaaattatactca

SEQ ID NO: 619 - DNA, 20 bp, Artificial sequence
  Synthetic oligonucleotide
gctatctttctatttgtgtc

SEQ ID NO: 620 - DNA, 20 bp, Artificial sequence
  Synthetic oligonucleotide
gagagcttttcctcttagat

SEQ ID NO: 621 - DNA, 20 bp, Artificial sequence
  Synthetic oligonucleotide
cgaagcaaattcaacagctc

SEQ ID NO: 622 - DNA, 20 bp, Artificial sequence
  Synthetic oligonucleotide
gcatcagacttacacttcac

SEQ ID NO: 623 - DNA, 20 bp, Artificial sequence
  Synthetic oligonucleotide
atgagctcaacagggtggta

SEQ ID NO: 624 - DNA, 20 bp, Artificial sequence
  Synthetic oligonucleotide
aggatagtctctttccatca

SEQ ID NO: 625 - DNA, 20 bp, Artificial sequence
  Synthetic oligonucleotide
gtagagataaacatttgggc

SEQ ID NO: 626 - DNA, 20 bp, Artificial sequence
  Synthetic oligonucleotide
gacacagttttgaataagat

SEQ ID NO: 627 - DNA, 20 bp, Artificial sequence
  Synthetic oligonucleotide
acaacacattattgtgccac

SEQ ID NO: 628 - DNA, 20 bp, Artificial sequence
  Synthetic oligonucleotide
tgctatcgaatactatgcag

SEQ ID NO: 629 - DNA, 20 bp, Artificial sequence
  Synthetic oligonucleotide
gtgtgatcatgcacatagaa

SEQ ID NO: 630 - DNA, 20 bp, Artificial sequence
  Synthetic oligonucleotide
ctctggcatatttcaagata

SEQ ID NO: 631 - DNA, 20 bp, Artificial sequence
  Synthetic oligonucleotide
ccatatttataaatttacaa

SEQ ID NO: 632 - DNA, 20 bp, Artificial sequence
  Synthetic oligonucleotide
gtgcttattattcatgttct

SEQ ID NO: 633 - DNA, 20 bp, Artificial sequence
  Synthetic oligonucleotide
tcttcaacagcctcccaacc

SEQ ID NO: 634 - DNA, 20 bp, Artificial sequence
  Synthetic oligonucleotide
tgaattttctctcccagcat

SEQ ID NO: 635 - DNA, 20 bp, Artificial sequence
  Synthetic oligonucleotide
atatatttgaaagttacaag

SEQ ID NO: 636 - DNA, 20 bp, Artificial sequence
  Synthetic oligonucleotide
gctaatgattaaactggata

SEQ ID NO: 637 - DNA, 20 bp, Artificial sequence
  Synthetic oligonucleotide
ttacctttatcacccaatta

SEQ ID NO: 638 - DNA, 20 bp, Artificial sequence
  Synthetic oligonucleotide
gtttttagtacatttaatga

SEQ ID NO: 639 - DNA, 20 bp, Artificial sequence
  Synthetic oligonucleotide
ctataatggcatatactgga

SEQ ID NO: 640 - DNA, 20 bp, Artificial sequence
  Synthetic oligonucleotide
taaacagtacctgctgtacc

SEQ ID NO: 641 - DNA, 20 bp, Artificial sequence
  Synthetic oligonucleotide
aaaatctcttttcaaattaa

SEQ ID NO: 642 - DNA, 20 bp, Artificial sequence
  Synthetic oligonucleotide
atttatgaccctttggagaa

SEQ ID NO: 643 - DNA, 20 bp, Artificial sequence
  Synthetic oligonucleotide
cttctaatttttgtaccaaa

SEQ ID NO: 644 - DNA, 20 bp, Artificial sequence
  Synthetic oligonucleotide
taattggaaattcggcccaa

SEQ ID NO: 645 - DNA, 20 bp, Artificial sequence
  Synthetic oligonucleotide
tgataccgcctgcgggtgcc

SEQ ID NO: 646 - DNA, 20 bp, Artificial sequence
  Synthetic oligonucleotide
agtcaccggaaaaaacgagt

SEQ ID NO: 647 - DNA, 20 bp, Artificial sequence
  Synthetic oligonucleotide
gcccccagccaccaccatga

SEQ ID NO: 648 - DNA, 20 bp, Artificial sequence
  Synthetic oligonucleotide
caaggccccccaccactgcc

SEQ ID NO: 649 - DNA, 20 bp, Artificial sequence
  Synthetic oligonucleotide
aggaagaccttcctcatccc

SEQ ID NO: 650 - DNA, 20 bp, Artificial sequence
  Synthetic oligonucleotide
catgatgaactcaatcaaag

SEQ ID NO: 651 - DNA, 20 bp, Artificial sequence
  Synthetic oligonucleotide
gtatccaggcaaaggtattt

SEQ ID NO: 652 - DNA, 20 bp, Artificial sequence
  Synthetic oligonucleotide
agtatcatgtggcctcctaa

SEQ ID NO: 653 - DNA, 20 bp, Artificial sequence
  Synthetic oligonucleotide
tttactcttgttgaacagct

SEQ ID NO: 654 - DNA, 20 bp, Artificial sequence
  Synthetic oligonucleotide
tgtgaatatgtcctctagcc

SEQ ID NO: 655 - DNA, 20 bp, Artificial sequence
  Synthetic oligonucleotide
cctttcatatatgttacagt

SEQ ID NO: 656 - DNA, 20 bp, Artificial sequence
  Synthetic oligonucleotide
caccattcccaaacatttga

SEQ ID NO: 657 - DNA, 20 bp, Artificial sequence
  Synthetic oligonucleotide
tgccttaattacctatagtt

SEQ ID NO: 658 - DNA, 20 bp, Artificial sequence
  Synthetic oligonucleotide
agatttgccttcagtgtcta

SEQ ID NO: 659 - DNA, 20 bp, Artificial sequence
  Synthetic oligonucleotide
cctgtatgtcaaaatcattc

SEQ ID NO: 660 - DNA, 20 bp, Artificial sequence
  Synthetic oligonucleotide
cctctatgatgatggtgctt

SEQ ID NO: 661 - DNA, 20 bp, Artificial sequence
  Synthetic oligonucleotide
tgcacactgaccatttttta

SEQ ID NO: 662 - DNA, 20 bp, Artificial sequence
  Synthetic oligonucleotide
tatgagacagaaataaagaa

SEQ ID NO: 663 - DNA, 20 bp, Artificial sequence
  Synthetic oligonucleotide
aaaagccaattacagaaact

SEQ ID NO: 664 - DNA, 20 bp, Artificial sequence
  Synthetic oligonucleotide
ttagattgtctccctattct

SEQ ID NO: 665 - DNA, 20 bp, Artificial sequence
  Synthetic oligonucleotide
catatttctgtcatctccaa

SEQ ID NO: 666 - DNA, 20 bp, Artificial sequence
  Synthetic oligonucleotide
gaatttctttttccacttca

SEQ ID NO: 667 - DNA, 20 bp, Artificial sequence
  Synthetic oligonucleotide
atatcaaacaattcagggaa

SEQ ID NO: 668 - DNA, 20 bp, Artificial sequence
  Synthetic oligonucleotide
gccaataataacattgcaga

SEQ ID NO: 669 - DNA, 20 bp, Artificial sequence
  Synthetic oligonucleotide
ttaactgctctaaacaaaac

SEQ ID NO: 670 - DNA, 20 bp, Artificial sequence
  Synthetic oligonucleotide
ggtttcccacatattaagta

SEQ ID NO: 671 - DNA, 20 bp, Artificial sequence
  Synthetic oligonucleotide
atataacaaaacaagaacat

SEQ ID NO: 672 - DNA, 20 bp, Artificial sequence
  Synthetic oligonucleotide
gccatgaagatcctcatcat

SEQ ID NO: 673 - DNA, 20 bp, Artificial sequence
  Synthetic oligonucleotide
tcctattctaccaggagttt

SEQ ID NO: 674 - DNA, 20 bp, Artificial sequence
  Synthetic oligonucleotide
tcctatgtttttgataatta

SEQ ID NO: 675 - DNA, 20 bp, Artificial sequence
  Synthetic oligonucleotide
tttccagaagtttaacatat

SEQ ID NO: 676 - DNA, 20 bp, Artificial sequence
  Synthetic oligonucleotide
gtaaaattgctcctttccac

SEQ ID NO: 677 - DNA, 20 bp, Artificial sequence
  Synthetic oligonucleotide
tgcttttccccttactggtt

SEQ ID NO: 678 - DNA, 20 bp, Artificial sequence
  Synthetic oligonucleotide
aatattttcctttcggtgtg

SEQ ID NO: 679 - DNA, 20 bp, Artificial sequence
  Synthetic oligonucleotide
cattttgccatttatctatt

SEQ ID NO: 680 - DNA, 20 bp, Artificial sequence
  Synthetic oligonucleotide
atgataacccaaacatgctc

SEQ ID NO: 681 - DNA, 20 bp, Artificial sequence
  Synthetic oligonucleotide
gactgcagaaccatctttgt

SEQ ID NO: 682 - DNA, 20 bp, Artificial sequence
  Synthetic oligonucleotide
ccccaataactcatacatac

SEQ ID NO: 683 - DNA, 20 bp, Artificial sequence
  Synthetic oligonucleotide
tgtttgtttcttccattgca

SEQ ID NO: 684 - DNA, 20 bp, Artificial sequence
  Synthetic oligonucleotide
atgtgtcataattttcttag

SEQ ID NO: 685 - DNA, 20 bp, Artificial sequence
  Synthetic oligonucleotide
acaggctccaaaatcatgat

SEQ ID NO: 686 - DNA, 20 bp, Artificial sequence
  Synthetic oligonucleotide
agttaataacccactttttt

SEQ ID NO: 687 - DNA, 20 bp, Artificial sequence
  Synthetic oligonucleotide
gagcaatatattcaccaaag

SEQ ID NO: 688 - DNA, 20 bp, Artificial sequence
  Synthetic oligonucleotide
gttggctaaaaatcttttat

SEQ ID NO: 689 - DNA, 20 bp, Artificial sequence
  Synthetic oligonucleotide
acagcctttcctgaccctca

SEQ ID NO: 690 - DNA, 20 bp, Artificial sequence
  Synthetic oligonucleotide
gcataattctaaaaatctgt

SEQ ID NO: 691 - DNA, 20 bp, Artificial sequence
  Synthetic oligonucleotide
tgcagaaacttctgttatgt

SEQ ID NO: 692 - DNA, 20 bp, Artificial sequence
  Synthetic oligonucleotide
gctgtagccatcactgggtt

SEQ ID NO: 693 - DNA, 20 bp, Artificial sequence
  Synthetic oligonucleotide
tgaaggattacctcccttaa

SEQ ID NO: 694 - DNA, 20 bp, Artificial sequence
  Synthetic oligonucleotide
cccttgtctcttctgagcta

SEQ ID NO: 695 - DNA, 20 bp, Artificial sequence
  Synthetic oligonucleotide
gacattatgaaattatactc

SEQ ID NO: 696 - DNA, 20 bp, Artificial sequence
  Synthetic oligonucleotide
ggctatctttctatttgtgt

SEQ ID NO: 697 - DNA, 20 bp, Artificial sequence
  Synthetic oligonucleotide
tgagagcttttcctcttaga

SEQ ID NO: 698 - DNA, 20 bp, Artificial sequence
  Synthetic oligonucleotide
gcgaagcaaattcaacagct

SEQ ID NO: 699 - DNA, 20 bp, Artificial sequence
  Synthetic oligonucleotide
ggaggcatcagacttacact

SEQ ID NO: 700 - DNA, 20 bp, Artificial sequence
  Synthetic oligonucleotide
tacatgagctcaacagggtg

SEQ ID NO: 701 - DNA, 20 bp, Artificial sequence
  Synthetic oligonucleotide
aaggatagtctctttccatc

SEQ ID NO: 702 - DNA, 20 bp, Artificial sequence
  Synthetic oligonucleotide
gggagtatcaatttaagcaa

SEQ ID NO: 703 - DNA, 20 bp, Artificial sequence
  Synthetic oligonucleotide
gtcagaattctaagggtcaa

SEQ ID NO: 704 - DNA, 20 bp, Artificial sequence
  Synthetic oligonucleotide
cccacaacacattattgtgc

SEQ ID NO: 705 - DNA, 20 bp, Artificial sequence
  Synthetic oligonucleotide
gtacatatatgctatcgaat

SEQ ID NO: 706 - DNA, 20 bp, Artificial sequence
  Synthetic oligonucleotide
aattagtgtgatcatgcaca

SEQ ID NO: 707 - DNA, 20 bp, Artificial sequence
  Synthetic oligonucleotide
agatactctctgtcaccagt

SEQ ID NO: 708 - DNA, 20 bp, Artificial sequence
  Synthetic oligonucleotide
accatatttataaatttaca

SEQ ID NO: 709 - DNA, 20 bp, Artificial sequence
  Synthetic oligonucleotide
tgtgcttattattcatgttc

SEQ ID NO: 710 - DNA, 20 bp, Artificial sequence
  Synthetic oligonucleotide
ctgatttcttcaacagcctc

SEQ ID NO: 711 - DNA, 20 bp, Artificial sequence
  Synthetic oligonucleotide
ctgaattttctctcccagca

SEQ ID NO: 712 - DNA, 20 bp, Artificial sequence
  Synthetic oligonucleotide
ggtcataagcaaatcaaaat

SEQ ID NO: 713 - DNA, 20 bp, Artificial sequence
  Synthetic oligonucleotide
tcagagctaatgattaaact

SEQ ID NO: 714 - DNA, 20 bp, Artificial sequence
  Synthetic oligonucleotide
cttacctttatcacccaatt

SEQ ID NO: 715 - DNA, 20 bp, Artificial sequence
  Synthetic oligonucleotide
tggtttttagtacatttaat

SEQ ID NO: 716 - DNA, 20 bp, Artificial sequence
  Synthetic oligonucleotide
cgtaaaacctataatggcat

SEQ ID NO: 717 - DNA, 20 bp, Artificial sequence
  Synthetic oligonucleotide
tgctaaacagtacctgctgt

SEQ ID NO: 718 - DNA, 20 bp, Artificial sequence
  Synthetic oligonucleotide
tcaaaaatctcttttcaaat

SEQ ID NO: 719 - DNA, 20 bp, Artificial sequence
  Synthetic oligonucleotide
agaatgacaatttatgaccc

SEQ ID NO: 720 - DNA, 20 bp, Artificial sequence
  Synthetic oligonucleotide
ttcttctaatttttgtacca

SEQ ID NO: 721 - DNA, 20 bp, Artificial sequence
  Synthetic oligonucleotide
ctttaattggaaattcggcc

SEQ ID NO: 722 - DNA, 20 bp, Artificial sequence
  Synthetic oligonucleotide
ttgataccgcctgcgggtgc

SEQ ID NO: 723 - DNA, 20 bp, Artificial sequence
  Synthetic oligonucleotide
gccacaaagagaaccagcat

SEQ ID NO: 724 - DNA, 20 bp, Artificial sequence
  Synthetic oligonucleotide
tgcccccagccaccaccatg

SEQ ID NO: 725 - DNA, 20 bp, Artificial sequence
  Synthetic oligonucleotide
ccaaggccccccaccactgc

SEQ ID NO: 726 - DNA, 20 bp, Artificial sequence
  Synthetic oligonucleotide
caggaagaccttcctcatcc

SEQ ID NO: 727 - DNA, 20 bp, Artificial sequence
  Synthetic oligonucleotide
tcatgatgaactcaatcaaa

SEQ ID NO: 728 - DNA, 20 bp, Artificial sequence
  Synthetic oligonucleotide
atgaaatctctactaagata

SEQ ID NO: 729 - DNA, 20 bp, Artificial sequence
  Synthetic oligonucleotide
aagtatcatgtggcctccta

SEQ ID NO: 730 - DNA, 20 bp, Artificial sequence
  Synthetic oligonucleotide
atttactcttgttgaacagc

SEQ ID NO: 731 - DNA, 20 bp, Artificial sequence
  Synthetic oligonucleotide
ctgtgaatatgtcctctagc

SEQ ID NO: 732 - DNA, 20 bp, Artificial sequence
  Synthetic oligonucleotide
gcctttcatatatgttacag

SEQ ID NO: 733 - DNA, 20 bp, Artificial sequence
  Synthetic oligonucleotide
ggcaccattcccaaacattt

SEQ ID NO: 734 - DNA, 20 bp, Artificial sequence
  Synthetic oligonucleotide
ctgccttaattacctatagt

SEQ ID NO: 735 - DNA, 20 bp, Artificial sequence
  Synthetic oligonucleotide
gagatttgccttcagtgtct

SEQ ID NO: 736 - DNA, 20 bp, Artificial sequence
  Synthetic oligonucleotide
gctctcctgtatgtcaaaat

SEQ ID NO: 737 - DNA, 20 bp, Artificial sequence
  Synthetic oligonucleotide
tcatcctctatgatgatggt

SEQ ID NO: 738 - DNA, 20 bp, Artificial sequence
  Synthetic oligonucleotide
ttgcacactgaccatttttt

SEQ ID NO: 739 - DNA, 20 bp, Artificial sequence
  Synthetic oligonucleotide
ttatgagacagaaataaaga

SEQ ID NO: 740 - DNA, 20 bp, Artificial sequence
  Synthetic oligonucleotide
caaaagccaattacagaaac

SEQ ID NO: 741 - DNA, 20 bp, Artificial sequence
  Synthetic oligonucleotide
tttagattgtctccctattc

SEQ ID NO: 742 - DNA, 20 bp, Artificial sequence
  Synthetic oligonucleotide
tcatatttctgtcatctcca

SEQ ID NO: 743 - DNA, 20 bp, Artificial sequence
  Synthetic oligonucleotide
agaatttctttttccacttc

SEQ ID NO: 744 - DNA, 20 bp, Artificial sequence
  Synthetic oligonucleotide
aatatcaaacaattcaggga

SEQ ID NO: 745 - DNA, 20 bp, Artificial sequence
  Synthetic oligonucleotide
aagccaataataacattgca

SEQ ID NO: 746 - DNA, 20 bp, Artificial sequence
  Synthetic oligonucleotide
tcagatgttaactgctctaa

SEQ ID NO: 747 - DNA, 20 bp, Artificial sequence
  Synthetic oligonucleotide
gggtttcccacatattaagt

SEQ ID NO: 748 - DNA, 20 bp, Artificial sequence
  Synthetic oligonucleotide
tatataacaaaacaagaaca

SEQ ID NO: 749 - DNA, 20 bp, Artificial sequence
  Synthetic oligonucleotide
gctctcagaacaagaaaata

SEQ ID NO: 750 - DNA, 20 bp, Artificial sequence
  Synthetic oligonucleotide
aatcctattctaccaggagt

SEQ ID NO: 751 - DNA, 20 bp, Artificial sequence
  Synthetic oligonucleotide
ctgttcctatgtttttgata

SEQ ID NO: 752 - DNA, 20 bp, Artificial sequence
  Synthetic oligonucleotide
gatttttccagaagtttaac

SEQ ID NO: 753 - DNA, 20 bp, Artificial sequence
  Synthetic oligonucleotide
agtaaaattgctcctttcca

SEQ ID NO: 754 - DNA, 20 bp, Artificial sequence
  Synthetic oligonucleotide
catcctacccctctgcctgc

SEQ ID NO: 755 - DNA, 20 bp, Artificial sequence
  Synthetic oligonucleotide
taatattttcctttcggtgt

SEQ ID NO: 756 - DNA, 20 bp, Artificial sequence
  Synthetic oligonucleotide
tcattttgccatttatctat

SEQ ID NO: 757 - DNA, 20 bp, Artificial sequence
  Synthetic oligonucleotide
aaatgataacccaaacatgc

SEQ ID NO: 758 - DNA, 20 bp, Artificial sequence
  Synthetic oligonucleotide
ccaaggtcacaaaattgact

SEQ ID NO: 759 - DNA, 20 bp, Artificial sequence
  Synthetic oligonucleotide
aaatgcccccaataactcat

SEQ ID NO: 760 - DNA, 20 bp, Artificial sequence
  Synthetic oligonucleotide
atacatgcctgtttttgttt

SEQ ID NO: 761 - DNA, 20 bp, Artificial sequence
  Synthetic oligonucleotide
aatgtgtcataattttctta

SEQ ID NO: 762 - DNA, 20 bp, Artificial sequence
  Synthetic oligonucleotide
atcacaggctccaaaatcat

SEQ ID NO: 763 - DNA, 20 bp, Artificial sequence
  Synthetic oligonucleotide
gcagttaataacccactttt

SEQ ID NO: 764 - DNA, 20 bp, Artificial sequence
  Synthetic oligonucleotide
agagcaatatattcaccaaa

SEQ ID NO: 765 - DNA, 20 bp, Artificial sequence
  Synthetic oligonucleotide
cgttggctaaaaatctttta

SEQ ID NO: 766 - DNA, 20 bp, Artificial sequence
  Synthetic oligonucleotide
gatcacagcctttcctgacc

SEQ ID NO: 767 - DNA, 20 bp, Artificial sequence
  Synthetic oligonucleotide
cagcataattctaaaaatct

SEQ ID NO: 768 - DNA, 20 bp, Artificial sequence
  Synthetic oligonucleotide
ggtgcagaaacttctgttat

SEQ ID NO: 769 - DNA, 20 bp, Artificial sequence
  Synthetic oligonucleotide
tgctgtagccatcactgggt

SEQ ID NO: 770 - DNA, 20 bp, Artificial sequence
  Synthetic oligonucleotide
ctgaaggattacctccctta

SEQ ID NO: 771 - DNA, 20 bp, Artificial sequence
  Synthetic oligonucleotide
ataatgtcccttgtctcttc

SEQ ID NO: 772 - DNA, 20 bp, Artificial sequence
  Synthetic oligonucleotide
acacaatacatataatctta

SEQ ID NO: 773 - DNA, 20 bp, Artificial sequence
  Synthetic oligonucleotide
aggctatctttctatttgtg

SEQ ID NO: 774 - DNA, 20 bp, Artificial sequence
  Synthetic oligonucleotide
ttgagagcttttcctcttag

SEQ ID NO: 775 - DNA, 20 bp, Artificial sequence
  Synthetic oligonucleotide
tagcgaagcaaattcaacag

SEQ ID NO: 776 - DNA, 20 bp, Artificial sequence
  Synthetic oligonucleotide
gatctcttagatttttggac

SEQ ID NO: 777 - DNA, 20 bp, Artificial sequence
  Synthetic oligonucleotide
tagaataaatacatgagctc

SEQ ID NO: 778 - DNA, 20 bp, Artificial sequence
  Synthetic oligonucleotide
tgaaaatcaatatcattcct

SEQ ID NO: 779 - DNA, 20 bp, Artificial sequence
  Synthetic oligonucleotide
tgggagtatcaatttaagca

SEQ ID NO: 780 - DNA, 20 bp, Artificial sequence
  Synthetic oligonucleotide
gtgtcagaattctaagggtc

SEQ ID NO: 781 - DNA, 20 bp, Artificial sequence
  Synthetic oligonucleotide
acccacaacacattattgtg

SEQ ID NO: 782 - DNA, 20 bp, Artificial sequence
  Synthetic oligonucleotide
gtgtggtacatatatgctat

SEQ ID NO: 783 - DNA, 20 bp, Artificial sequence
  Synthetic oligonucleotide
atttgcaattagtgtgatca

SEQ ID NO: 784 - DNA, 20 bp, Artificial sequence
  Synthetic oligonucleotide
taagatactctctgtcacca

SEQ ID NO: 785 - DNA, 20 bp, Artificial sequence
  Synthetic oligonucleotide
actaaatatttataatggat

SEQ ID NO: 786 - DNA, 20 bp, Artificial sequence
  Synthetic oligonucleotide
ctgtgcttattattcatgtt

SEQ ID NO: 787 - DNA, 20 bp, Artificial sequence
  Synthetic oligonucleotide
ttctcacctgatttcttcaa

SEQ ID NO: 788 - DNA, 20 bp, Artificial sequence
  Synthetic oligonucleotide
tgactgaattttctctccca

SEQ ID NO: 789 - DNA, 20 bp, Artificial sequence
  Synthetic oligonucleotide
tggtcataagcaaatcaaaa

SEQ ID NO: 790 - DNA, 20 bp, Artificial sequence
  Synthetic oligonucleotide
ttcagagctaatgattaaac

SEQ ID NO: 791 - DNA, 20 bp, Artificial sequence
  Synthetic oligonucleotide
ccttacctttatcacccaat

SEQ ID NO: 792 - DNA, 20 bp, Artificial sequence
  Synthetic oligonucleotide
catgtacagttcaatggttt

SEQ ID NO: 793 - DNA, 20 bp, Artificial sequence
  Synthetic oligonucleotide
ccgtaaaacctataatggca

SEQ ID NO: 794 - DNA, 20 bp, Artificial sequence
  Synthetic oligonucleotide
gattgctaaacagtacctgc

SEQ ID NO: 795 - DNA, 20 bp, Artificial sequence
  Synthetic oligonucleotide
atcaaaaatctcttttcaaa

SEQ ID NO: 796 - DNA, 20 bp, Artificial sequence
  Synthetic oligonucleotide
cagaatgacaatttatgacc

SEQ ID NO: 797 - DNA, 20 bp, Artificial sequence
  Synthetic oligonucleotide
tttcttctaatttttgtacc

SEQ ID NO: 798 - DNA, 20 bp, Artificial sequence
  Synthetic oligonucleotide
aatcatctttaattggaaat

SEQ ID NO: 799 - DNA, 20 bp, Artificial sequence
  Synthetic oligonucleotide
tgaacacttgcatcagttga

SEQ ID NO: 800 - DNA, 20 bp, Artificial sequence
  Synthetic oligonucleotide
ccaggtcactccatgtggcc

SEQ ID NO: 801 - DNA, 20 bp, Artificial sequence
  Synthetic oligonucleotide
atgaggctgcccccagccac

SEQ ID NO: 802 - DNA, 20 bp, Artificial sequence
  Synthetic oligonucleotide
agtaacggtcctcatagtca

SEQ ID NO: 803 - DNA, 20 bp, Artificial sequence
  Synthetic oligonucleotide
aagatggtgaaaacaggaag

SEQ ID NO: 804 - DNA, 20 bp, Artificial sequence
  Synthetic oligonucleotide
ctgttatacttttactggcc

SEQ ID NO: 805 - DNA, 20 bp, Artificial sequence
  Synthetic oligonucleotide
atagctatgaaatctctact

SEQ ID NO: 806 - DNA, 20 bp, Artificial sequence
  Synthetic oligonucleotide
taggatttttttgaataagt

SEQ ID NO: 807 - DNA, 20 bp, Artificial sequence
  Synthetic oligonucleotide
gacaatatttactcttgttg

SEQ ID NO: 808 - DNA, 20 bp, Artificial sequence
  Synthetic oligonucleotide
tgttcactgtgaatatgtcc

SEQ ID NO: 809 - DNA, 20 bp, Artificial sequence
  Synthetic oligonucleotide
cccagaagcctttcatatat

SEQ ID NO: 810 - DNA, 20 bp, Artificial sequence
  Synthetic oligonucleotide
tccaagggcaccattcccaa

SEQ ID NO: 811 - DNA, 20 bp, Artificial sequence
  Synthetic oligonucleotide
tttcagctgccttaattacc

SEQ ID NO: 812 - DNA, 20 bp, Artificial sequence
  Synthetic oligonucleotide
aaaggagatttgccttcagt

SEQ ID NO: 813 - DNA, 20 bp, Artificial sequence
  Synthetic oligonucleotide
ctgcagctctcctgtatgtc

SEQ ID NO: 814 - DNA, 20 bp, Artificial sequence
  Synthetic oligonucleotide
tacatcatcctctatgatga

SEQ ID NO: 815 - DNA, 20 bp, Artificial sequence
  Synthetic oligonucleotide
ttttctttgcacactgacca

SEQ ID NO: 816 - DNA, 20 bp, Artificial sequence
  Synthetic oligonucleotide
ctaattctggtttttgacaa

SEQ ID NO: 817 - DNA, 20 bp, Artificial sequence
  Synthetic oligonucleotide
tctttgattcaaaagccaat

SEQ ID NO: 818 - DNA, 20 bp, Artificial sequence
  Synthetic oligonucleotide
gatattttttagattgtctc

SEQ ID NO: 819 - DNA, 20 bp, Artificial sequence
  Synthetic oligonucleotide
tcaatcatatttctgtcatc

SEQ ID NO: 820 - DNA, 20 bp, Artificial sequence
  Synthetic oligonucleotide
attaacagaatttctttttc

SEQ ID NO: 821 - DNA, 20 bp, Artificial sequence
  Synthetic oligonucleotide
ggtgacaatatcaaacaatt

SEQ ID NO: 822 - DNA, 20 bp, Artificial sequence
  Synthetic oligonucleotide
gaatactcacaaagtgcaag

SEQ ID NO: 823 - DNA, 20 bp, Artificial sequence
  Synthetic oligonucleotide
cattagacacttcagatgtt

SEQ ID NO: 824 - DNA, 20 bp, Artificial sequence
  Synthetic oligonucleotide
atgaaacgattcagtgcaca

SEQ ID NO: 825 - DNA, 20 bp, Artificial sequence
  Synthetic oligonucleotide
caatttttttatataacaaa

SEQ ID NO: 826 - DNA, 20 bp, Artificial sequence
  Synthetic oligonucleotide
cgtgatgctctcagaacaag

SEQ ID NO: 827 - DNA, 20 bp, Artificial sequence
  Synthetic oligonucleotide
atccttaatcctattctacc

SEQ ID NO: 828 - DNA, 20 bp, Artificial sequence
  Synthetic oligonucleotide
tttatccaattccctgttcc

SEQ ID NO: 829 - DNA, 20 bp, Artificial sequence
  Synthetic oligonucleotide
ttgttgatttttccagaagt

SEQ ID NO: 830 - DNA, 20 bp, Artificial sequence
  Synthetic oligonucleotide
tgtgtaagtaaaattgctcc

SEQ ID NO: 831 - DNA, 20 bp, Artificial sequence
  Synthetic oligonucleotide
caaatcacatcctacccctc

SEQ ID NO: 832 - DNA, 20 bp, Artificial sequence
  Synthetic oligonucleotide
aatcttaatattttcctttc

SEQ ID NO: 833 - DNA, 20 bp, Artificial sequence
  Synthetic oligonucleotide
aatgactcatcattttgcca

SEQ ID NO: 834 - DNA, 20 bp, Artificial sequence
  Synthetic oligonucleotide
tggttattttaatagatgta

SEQ ID NO: 835 - DNA, 20 bp, Artificial sequence
  Synthetic oligonucleotide
atcatttcctccattctatg

SEQ ID NO: 836 - DNA, 20 bp, Artificial sequence
  Synthetic oligonucleotide
gcttaacaaaatgtttgtca

SEQ ID NO: 837 - DNA, 20 bp, Artificial sequence
  Synthetic oligonucleotide
ttctaattttagatcattct

SEQ ID NO: 838 - DNA, 20 bp, Artificial sequence
  Synthetic oligonucleotide
ttcatttcagttaatgtgtc

SEQ ID NO: 839 - DNA, 20 bp, Artificial sequence
  Synthetic oligonucleotide
agtttttccccacatatcac

SEQ ID NO: 840 - DNA, 20 bp, Artificial sequence
  Synthetic oligonucleotide
ttcagatttttcacatatgc

SEQ ID NO: 841 - DNA, 20 bp, Artificial sequence
  Synthetic oligonucleotide
tagtgagagcaatatattca

SEQ ID NO: 842 - DNA, 20 bp, Artificial sequence
  Synthetic oligonucleotide
gttttgaaaaatattcagga

SEQ ID NO: 843 - DNA, 20 bp, Artificial sequence
  Synthetic oligonucleotide
gatcaagagcttgtgatcac

SEQ ID NO: 844 - DNA, 20 bp, Artificial sequence
  Synthetic oligonucleotide
cccttacataattcagcata

SEQ ID NO: 845 - DNA, 20 bp, Artificial sequence
  Synthetic oligonucleotide
tgacagccatgttcagtgtc

SEQ ID NO: 846 - DNA, 20 bp, Artificial sequence
  Synthetic oligonucleotide
cacttaggagttattttata

SEQ ID NO: 847 - DNA, 20 bp, Artificial sequence
  Synthetic oligonucleotide
catttataatgcttttcact

SEQ ID NO: 848 - DNA, 20 bp, Artificial sequence
  Synthetic oligonucleotide
cttaattagttacatcggga

SEQ ID NO: 849 - DNA, 20 bp, Artificial sequence
  Synthetic oligonucleotide
cgtgtgagcattcttgtctt

SEQ ID NO: 850 - DNA, 20 bp, Artificial sequence
  Synthetic oligonucleotide
aacattaattatccccccat

SEQ ID NO: 851 - DNA, 20 bp, Artificial sequence
  Synthetic oligonucleotide
cattgtacctcaacacaata

SEQ ID NO: 852 - DNA, 20 bp, Artificial sequence
  Synthetic oligonucleotide
accagcattatcctgatgtc

SEQ ID NO: 853 - DNA, 20 bp, Artificial sequence
  Synthetic oligonucleotide
tcaaaggtaattttataacc

SEQ ID NO: 854 - DNA, 20 bp, Artificial sequence
  Synthetic oligonucleotide
ctaggtataatttttttacc

SEQ ID NO: 855 - DNA, 20 bp, Artificial sequence
  Synthetic oligonucleotide
tgttgaaaagttttcaatga

SEQ ID NO: 856 - DNA, 20 bp, Artificial sequence
  Synthetic oligonucleotide
ggtgatgccatctactgaaa

SEQ ID NO: 857 - DNA, 20 bp, Artificial sequence
  Synthetic oligonucleotide
taacacacatttcaagtgtc

SEQ ID NO: 858 - DNA, 20 bp, Artificial sequence
  Synthetic oligonucleotide
agtaccataacctttttttt

SEQ ID NO: 859 - DNA, 20 bp, Artificial sequence
  Synthetic oligonucleotide
acggaaatatcattcgactc

SEQ ID NO: 860 - DNA, 20 bp, Artificial sequence
  Synthetic oligonucleotide
ctagctgacactatttgcaa

SEQ ID NO: 861 - DNA, 20 bp, Artificial sequence
  Synthetic oligonucleotide
agaggagaagaaccaggcac

SEQ ID NO: 862 - DNA, 20 bp, Artificial sequence
  Synthetic oligonucleotide
gcataaggaataatcaaact

SEQ ID NO: 863 - DNA, 20 bp, Artificial sequence
  Synthetic oligonucleotide
ttatgttatttcctctgtgc

SEQ ID NO: 864 - DNA, 20 bp, Artificial sequence
  Synthetic oligonucleotide
ttattcggtgcttccatcac

SEQ ID NO: 865 - DNA, 20 bp, Artificial sequence
  Synthetic oligonucleotide
atgtcagcaccttctccatt

SEQ ID NO: 866 - DNA, 20 bp, Artificial sequence
  Synthetic oligonucleotide
ctaacattattgaaatggga

SEQ ID NO: 867 - DNA, 20 bp, Artificial sequence
  Synthetic oligonucleotide
attatttttcatctccttca

SEQ ID NO: 868 - DNA, 20 bp, Artificial sequence
  Synthetic oligonucleotide
aaccccttacctttatcacc

SEQ ID NO: 869 - DNA, 20 bp, Artificial sequence
  Synthetic oligonucleotide
attcaccatataccatgtac

SEQ ID NO: 870 - DNA, 20 bp, Artificial sequence
  Synthetic oligonucleotide
aaatcatcactgtgtgccgt

SEQ ID NO: 871 - DNA, 20 bp, Artificial sequence
  Synthetic oligonucleotide
agagacctatgacaatagta

SEQ ID NO: 872 - DNA, 20 bp, Artificial sequence
  Synthetic oligonucleotide
atcaaatcaaaaatctcttt

SEQ ID NO: 873 - DNA, 20 bp, Artificial sequence
  Synthetic oligonucleotide
atcaaacatccagaatgaca

SEQ ID NO: 874 - DNA, 20 bp, Artificial sequence
  Synthetic oligonucleotide
gttcattatttaacatttta

SEQ ID NO: 875 - DNA, 20 bp, Artificial sequence
  Synthetic oligonucleotide
aaaaatcatctttaattgga

SEQ ID NO: 876 - DNA, 20 bp, Artificial sequence
  Synthetic oligonucleotide
ttgaacacttgcatcagttg

SEQ ID NO: 877 - DNA, 20 bp, Artificial sequence
  Synthetic oligonucleotide
gtgttccatcctccaggctt

SEQ ID NO: 878 - DNA, 20 bp, Artificial sequence
  Synthetic oligonucleotide
catgaggctgcccccagcca

SEQ ID NO: 879 - DNA, 20 bp, Artificial sequence
  Synthetic oligonucleotide
tgcatgttttcacgatagta

SEQ ID NO: 880 - DNA, 20 bp, Artificial sequence
  Synthetic oligonucleotide
tgagacaccaccactaaaag

SEQ ID NO: 881 - DNA, 20 bp, Artificial sequence
  Synthetic oligonucleotide
tttgctgttatacttttact

SEQ ID NO: 882 - DNA, 20 bp, Artificial sequence
  Synthetic oligonucleotide
aaatagctatgaaatctcta

SEQ ID NO: 883 - DNA, 20 bp, Artificial sequence
  Synthetic oligonucleotide
tctaggatttttttgaataa

SEQ ID NO: 884 - DNA, 20 bp, Artificial sequence
  Synthetic oligonucleotide
tgacaatatttactcttgtt

SEQ ID NO: 885 - DNA, 20 bp, Artificial sequence
  Synthetic oligonucleotide
atgttcactgtgaatatgtc

SEQ ID NO: 886 - DNA, 20 bp, Artificial sequence
  Synthetic oligonucleotide
tcccagaagcctttcatata

SEQ ID NO: 887 - DNA, 20 bp, Artificial sequence
  Synthetic oligonucleotide
ctccaagggcaccattccca

SEQ ID NO: 888 - DNA, 20 bp, Artificial sequence
  Synthetic oligonucleotide
tttacttttcagctgcctta

SEQ ID NO: 889 - DNA, 20 bp, Artificial sequence
  Synthetic oligonucleotide
caaaggagatttgccttcag

SEQ ID NO: 890 - DNA, 20 bp, Artificial sequence
  Synthetic oligonucleotide
actgcagctctcctgtatgt

SEQ ID NO: 891 - DNA, 20 bp, Artificial sequence
  Synthetic oligonucleotide
ttacatcatcctctatgatg

SEQ ID NO: 892 - DNA, 20 bp, Artificial sequence
  Synthetic oligonucleotide
cttttctttgcacactgacc

SEQ ID NO: 893 - DNA, 20 bp, Artificial sequence
  Synthetic oligonucleotide
cctaattctggtttttgaca

SEQ ID NO: 894 - DNA, 20 bp, Artificial sequence
  Synthetic oligonucleotide
ttctttgattcaaaagccaa

SEQ ID NO: 895 - DNA, 20 bp, Artificial sequence
  Synthetic oligonucleotide
agatattttttagattgtct

SEQ ID NO: 896 - DNA, 20 bp, Artificial sequence
  Synthetic oligonucleotide
atcaatcatatttctgtcat

SEQ ID NO: 897 - DNA, 20 bp, Artificial sequence
  Synthetic oligonucleotide
ttaacattaacagaatttct

SEQ ID NO: 898 - DNA, 20 bp, Artificial sequence
  Synthetic oligonucleotide
aggtgacaatatcaaacaat

SEQ ID NO: 899 - DNA, 20 bp, Artificial sequence
  Synthetic oligonucleotide
agaatactcacaaagtgcaa

SEQ ID NO: 900 - DNA, 20 bp, Artificial sequence
  Synthetic oligonucleotide
gcattagacacttcagatgt

SEQ ID NO: 901 - DNA, 20 bp, Artificial sequence
  Synthetic oligonucleotide
attcttacatgaaacgattc

SEQ ID NO: 902 - DNA, 20 bp, Artificial sequence
  Synthetic oligonucleotide
tacaatttttttatataaca

SEQ ID NO: 903 - DNA, 20 bp, Artificial sequence
  Synthetic oligonucleotide
ccgtgatgctctcagaacaa

SEQ ID NO: 904 - DNA, 20 bp, Artificial sequence
  Synthetic oligonucleotide
aatccttaatcctattctac

SEQ ID NO: 905 - DNA, 20 bp, Artificial sequence
  Synthetic oligonucleotide
atttatccaattccctgttc

SEQ ID NO: 906 - DNA, 20 bp, Artificial sequence
  Synthetic oligonucleotide
gttgttgatttttccagaag

SEQ ID NO: 907 - DNA, 20 bp, Artificial sequence
  Synthetic oligonucleotide
ttgtgtaagtaaaattgctc

SEQ ID NO: 908 - DNA, 20 bp, Artificial sequence
  Synthetic oligonucleotide
acaaatcacatcctacccct

SEQ ID NO: 909 - DNA, 20 bp, Artificial sequence
  Synthetic oligonucleotide
taatcttaatattttccttt

SEQ ID NO: 910 - DNA, 20 bp, Artificial sequence
  Synthetic oligonucleotide
aaatgactcatcattttgcc

SEQ ID NO: 911 - DNA, 20 bp, Artificial sequence
  Synthetic oligonucleotide
ttggttattttaatagatgt

SEQ ID NO: 912 - DNA, 20 bp, Artificial sequence
  Synthetic oligonucleotide
ctatcatttcctccattcta

SEQ ID NO: 913 - DNA, 20 bp, Artificial sequence
  Synthetic oligonucleotide
tgcttaacaaaatgtttgtc

SEQ ID NO: 914 - DNA, 20 bp, Artificial sequence
  Synthetic oligonucleotide
gttctaattttagatcattc

SEQ ID NO: 915 - DNA, 20 bp, Artificial sequence
  Synthetic oligonucleotide
atgttcatttcagttaatgt

SEQ ID NO: 916 - DNA, 20 bp, Artificial sequence
  Synthetic oligonucleotide
cagtttttccccacatatca

SEQ ID NO: 917 - DNA, 20 bp, Artificial sequence
  Synthetic oligonucleotide
tttcagatttttcacatatg

SEQ ID NO: 918 - DNA, 20 bp, Artificial sequence
  Synthetic oligonucleotide
gtgaactattttttaaacgc

SEQ ID NO: 919 - DNA, 20 bp, Artificial sequence
  Synthetic oligonucleotide
atggctgaaattgttcagtt

SEQ ID NO: 920 - DNA, 20 bp, Artificial sequence
  Synthetic oligonucleotide
ccgagtggcctctggatcaa

SEQ ID NO: 921 - DNA, 20 bp, Artificial sequence
  Synthetic oligonucleotide
tcccttacataattcagcat

SEQ ID NO: 922 - DNA, 20 bp, Artificial sequence
  Synthetic oligonucleotide
gttgacagccatgttcagtg

SEQ ID NO: 923 - DNA, 20 bp, Artificial sequence
  Synthetic oligonucleotide
cacacactattcacttagga

SEQ ID NO: 924 - DNA, 20 bp, Artificial sequence
  Synthetic oligonucleotide
acatttataatgcttttcac

SEQ ID NO: 925 - DNA, 20 bp, Artificial sequence
  Synthetic oligonucleotide
gaagcttaattagttacatc

SEQ ID NO: 926 - DNA, 20 bp, Artificial sequence
  Synthetic oligonucleotide
tgcagtaccatatgttgaat

SEQ ID NO: 927 - DNA, 20 bp, Artificial sequence
  Synthetic oligonucleotide
caacattaattatcccccca

SEQ ID NO: 928 - DNA, 20 bp, Artificial sequence
  Synthetic oligonucleotide
gcattgtacctcaacacaat

SEQ ID NO: 929 - DNA, 20 bp, Artificial sequence
  Synthetic oligonucleotide
caagttttttttctaagcat

SEQ ID NO: 930 - DNA, 20 bp, Artificial sequence
  Synthetic oligonucleotide
tcagtcagaattcaaaggta

SEQ ID NO: 931 - DNA, 20 bp, Artificial sequence
  Synthetic oligonucleotide
tctaggtataatttttttac

SEQ ID NO: 932 - DNA, 20 bp, Artificial sequence
  Synthetic oligonucleotide
aaagattttcttcagatgtt

SEQ ID NO: 933 - DNA, 20 bp, Artificial sequence
  Synthetic oligonucleotide
gtctgggacttccataacca

SEQ ID NO: 934 - DNA, 20 bp, Artificial sequence
  Synthetic oligonucleotide
ttaacacacatttcaagtgt

SEQ ID NO: 935 - DNA, 20 bp, Artificial sequence
  Synthetic oligonucleotide
cagtaccataaccttttttt

SEQ ID NO: 936 - DNA, 20 bp, Artificial sequence
  Synthetic oligonucleotide
gacggaaatatcattcgact

SEQ ID NO: 937 - DNA, 20 bp, Artificial sequence
  Synthetic oligonucleotide
gctaagaatacactcagaaa

SEQ ID NO: 938 - DNA, 20 bp, Artificial sequence
  Synthetic oligonucleotide
agagacacctgaacaggcga

SEQ ID NO: 939 - DNA, 20 bp, Artificial sequence
  Synthetic oligonucleotide
agcataaggaataatcaaac

SEQ ID NO: 940 - DNA, 20 bp, Artificial sequence
  Synthetic oligonucleotide
attatgttatttcctctgtg

SEQ ID NO: 941 - DNA, 20 bp, Artificial sequence
  Synthetic oligonucleotide
catgaccatcttattcggtg

SEQ ID NO: 942 - DNA, 20 bp, Artificial sequence
  Synthetic oligonucleotide
ttatgtcagcaccttctcca

SEQ ID NO: 943 - DNA, 20 bp, Artificial sequence
  Synthetic oligonucleotide
ttctactaacattattgaaa

SEQ ID NO: 944 - DNA, 20 bp, Artificial sequence
  Synthetic oligonucleotide
aattatttttcatctccttc

SEQ ID NO: 945 - DNA, 20 bp, Artificial sequence
  Synthetic oligonucleotide
aaaccccttacctttatcac

SEQ ID NO: 946 - DNA, 20 bp, Artificial sequence
  Synthetic oligonucleotide
taattcaccatataccatgt

SEQ ID NO: 947 - DNA, 20 bp, Artificial sequence
  Synthetic oligonucleotide
ccaaatcatcactgtgtgcc

SEQ ID NO: 948 - DNA, 20 bp, Artificial sequence
  Synthetic oligonucleotide
gagcagagacctatgacaat

SEQ ID NO: 949 - DNA, 20 bp, Artificial sequence
  Synthetic oligonucleotide
catcaaatcaaaaatctctt

SEQ ID NO: 950 - DNA, 20 bp, Artificial sequence
  Synthetic oligonucleotide
gatcaaacatccagaatgac

SEQ ID NO: 951 - DNA, 20 bp, Artificial sequence
  Synthetic oligonucleotide
tagttcattatttaacattt

SEQ ID NO: 952 - DNA, 20 bp, Artificial sequence
  Synthetic oligonucleotide
taaaaatcatctttaattgg

SEQ ID NO: 953 - DNA, 20 bp, Artificial sequence
  Synthetic oligonucleotide
cttgaacacttgcatcagtt

SEQ ID NO: 954 - DNA, 20 bp, Artificial sequence
  Synthetic oligonucleotide
cagtgttccatcctccaggc

SEQ ID NO: 955 - DNA, 20 bp, Artificial sequence
  Synthetic oligonucleotide
ccatgaggctgcccccagcc

SEQ ID NO: 956 - DNA, 20 bp, Artificial sequence
  Synthetic oligonucleotide
ttgttctggttgctgtactc

SEQ ID NO: 957 - DNA, 20 bp, Artificial sequence
  Synthetic oligonucleotide
gagtgagacaccaccactaa

SEQ ID NO: 958 - DNA, 20 bp, Artificial sequence
  Synthetic oligonucleotide
cagattaaccaatggttatt

SEQ ID NO: 959 - DNA, 20 bp, Artificial sequence
  Synthetic oligonucleotide
aaaatatctctaaatagcta

SEQ ID NO: 960 - DNA, 20 bp, Artificial sequence
  Synthetic oligonucleotide
ctctaggatttttttgaata

SEQ ID NO: 961 - DNA, 20 bp, Artificial sequence
  Synthetic oligonucleotide
gtgacaatatttactcttgt

SEQ ID NO: 962 - DNA, 20 bp, Artificial sequence
  Synthetic oligonucleotide
gttatgttcactgtgaatat

SEQ ID NO: 963 - DNA, 20 bp, Artificial sequence
  Synthetic oligonucleotide
gtcccagaagcctttcatat

SEQ ID NO: 964 - DNA, 20 bp, Artificial sequence
  Synthetic oligonucleotide
aggttgcctccaagggcacc

SEQ ID NO: 965 - DNA, 20 bp, Artificial sequence
  Synthetic oligonucleotide
atttacttttcagctgcctt

SEQ ID NO: 966 - DNA, 20 bp, Artificial sequence
  Synthetic oligonucleotide
tttccaggtaaatggacaaa

SEQ ID NO: 967 - DNA, 20 bp, Artificial sequence
  Synthetic oligonucleotide
tcacaactgcagctctcctg

SEQ ID NO: 968 - DNA, 20 bp, Artificial sequence
  Synthetic oligonucleotide
aattacatcatcctctatga

SEQ ID NO: 969 - DNA, 20 bp, Artificial sequence
  Synthetic oligonucleotide
tcttttctttgcacactgac

SEQ ID NO: 970 - DNA, 20 bp, Artificial sequence
  Synthetic oligonucleotide
acctaattctggtttttgac

SEQ ID NO: 971 - DNA, 20 bp, Artificial sequence
  Synthetic oligonucleotide
attctttgattcaaaagcca

SEQ ID NO: 972 - DNA, 20 bp, Artificial sequence
  Synthetic oligonucleotide
aagatattttttagattgtc

SEQ ID NO: 973 - DNA, 20 bp, Artificial sequence
  Synthetic oligonucleotide
aatcaatcatatttctgtca

SEQ ID NO: 974 - DNA, 20 bp, Artificial sequence
  Synthetic oligonucleotide
attaacattaacagaatttc

SEQ ID NO: 975 - DNA, 20 bp, Artificial sequence
  Synthetic oligonucleotide
taggtgacaatatcaaacaa

SEQ ID NO: 976 - DNA, 20 bp, Artificial sequence
  Synthetic oligonucleotide
tagaatactcacaaagtgca

SEQ ID NO: 977 - DNA, 20 bp, Artificial sequence
  Synthetic oligonucleotide
gttaatgcattagacacttc

SEQ ID NO: 978 - DNA, 20 bp, Artificial sequence
  Synthetic oligonucleotide
ctttggattcttacatgaaa

SEQ ID NO: 979 - DNA, 20 bp, Artificial sequence
  Synthetic oligonucleotide
atattaaacatttacaattt

SEQ ID NO: 980 - DNA, 20 bp, Artificial sequence
  Synthetic oligonucleotide
accgtgatgctctcagaaca

SEQ ID NO: 981 - DNA, 20 bp, Artificial sequence
  Synthetic oligonucleotide
aaatccttaatcctattcta

SEQ ID NO: 982 - DNA, 20 bp, Artificial sequence
  Synthetic oligonucleotide
tatttatccaattccctgtt

SEQ ID NO: 983 - DNA, 20 bp, Artificial sequence
  Synthetic oligonucleotide
tcttctacaaatctaagagc

SEQ ID NO: 984 - DNA, 20 bp, Artificial sequence
  Synthetic oligonucleotide
ctctgtgtttgtgtaagtaa

SEQ ID NO: 985 - DNA, 20 bp, Artificial sequence
  Synthetic oligonucleotide
tacaaatcacatcctacccc

SEQ ID NO: 986 - DNA, 20 bp, Artificial sequence
  Synthetic oligonucleotide
ataatcttaatattttcctt

SEQ ID NO: 987 - DNA, 20 bp, Artificial sequence
  Synthetic oligonucleotide
taaatgactcatcattttgc

SEQ ID NO: 988 - DNA, 20 bp, Artificial sequence
  Synthetic oligonucleotide
ttttggttattttaatagat

SEQ ID NO: 989 - DNA, 20 bp, Artificial sequence
  Synthetic oligonucleotide
gctatcatttcctccattct

SEQ ID NO: 990 - DNA, 20 bp, Artificial sequence
  Synthetic oligonucleotide
gattgcttaacaaaatgttt

SEQ ID NO: 991 - DNA, 20 bp, Artificial sequence
  Synthetic oligonucleotide
gtgttctaattttagatcat

SEQ ID NO: 992 - DNA, 20 bp, Artificial sequence
  Synthetic oligonucleotide
ataatgttcatttcagttaa

SEQ ID NO: 993 - DNA, 20 bp, Artificial sequence
  Synthetic oligonucleotide
tcagtttttccccacatatc

SEQ ID NO: 994 - DNA, 20 bp, Artificial sequence
  Synthetic oligonucleotide
ctttcagatttttcacatat

SEQ ID NO: 995 - DNA, 20 bp, Artificial sequence
  Synthetic oligonucleotide
ctgtgaactattttttaaac

SEQ ID NO: 996 - DNA, 20 bp, Artificial sequence
  Synthetic oligonucleotide
tagatttgtgcctccaggaa

SEQ ID NO: 997 - DNA, 20 bp, Artificial sequence
  Synthetic oligonucleotide
tcacacagatgcacccgagt

SEQ ID NO: 998 - DNA, 20 bp, Artificial sequence
  Synthetic oligonucleotide
ctcccttacataattcagca

SEQ ID NO: 999 - DNA, 20 bp, Artificial sequence
  Synthetic oligonucleotide
agaatctttcaccttggttt

SEQ ID NO: 1000 - DNA, 20 bp, Artificial sequence
  Synthetic oligonucleotide
gaattgctgcacacactatt

SEQ ID NO: 1001 - DNA, 20 bp, Artificial sequence
  Synthetic oligonucleotide
cttcaacatttataatgctt

SEQ ID NO: 1002 - DNA, 20 bp, Artificial sequence
  Synthetic oligonucleotide
acttgaagcttaattagtta

SEQ ID NO: 1003 - DNA, 20 bp, Artificial sequence
  Synthetic oligonucleotide
ggaacaatttaactttttcc

SEQ ID NO: 1004 - DNA, 20 bp, Artificial sequence
  Synthetic oligonucleotide
acaacattaattatcccccc

SEQ ID NO: 1005 - DNA, 20 bp, Artificial sequence
  Synthetic oligonucleotide
agcattgtacctcaacacaa

SEQ ID NO: 1006 - DNA, 20 bp, Artificial sequence
  Synthetic oligonucleotide
tcaagttttttttctaagca

SEQ ID NO: 1007 - DNA, 20 bp, Artificial sequence
  Synthetic oligonucleotide
agtaaacacaatttcagtca

SEQ ID NO: 1008 - DNA, 20 bp, Artificial sequence
  Synthetic oligonucleotide
catctaggtataattttttt

SEQ ID NO: 1009 - DNA, 20 bp, Artificial sequence
  Synthetic oligonucleotide
agaaaagattttcttcagat

SEQ ID NO: 1010 - DNA, 20 bp, Artificial sequence
  Synthetic oligonucleotide
tgagacatattttacagaaa

SEQ ID NO: 1011 - DNA, 20 bp, Artificial sequence
  Synthetic oligonucleotide
cttaacacacatttcaagtg

SEQ ID NO: 1012 - DNA, 20 bp, Artificial sequence
  Synthetic oligonucleotide
tgtaatataatatttacagt

SEQ ID NO: 1013 - DNA, 20 bp, Artificial sequence
  Synthetic oligonucleotide
gaatttgattacatcctcaa

SEQ ID NO: 1014 - DNA, 20 bp, Artificial sequence
  Synthetic oligonucleotide
aatacctgtttattactaag

SEQ ID NO: 1015 - DNA, 20 bp, Artificial sequence
  Synthetic oligonucleotide
ctcttagagacacctgaaca

SEQ ID NO: 1016 - DNA, 20 bp, Artificial sequence
  Synthetic oligonucleotide
acacatgttataaagcataa

SEQ ID NO: 1017 - DNA, 20 bp, Artificial sequence
  Synthetic oligonucleotide
gagatattatgttatttcct

SEQ ID NO: 1018 - DNA, 20 bp, Artificial sequence
  Synthetic oligonucleotide
caatttttccaacatgacca

SEQ ID NO: 1019 - DNA, 20 bp, Artificial sequence
  Synthetic oligonucleotide
aagggcttttatgtcagcac

SEQ ID NO: 1020 - DNA, 20 bp, Artificial sequence
  Synthetic oligonucleotide
tttctactaacattattgaa

SEQ ID NO: 1021 - DNA, 20 bp, Artificial sequence
  Synthetic oligonucleotide
aaattatttttcatctcctt

SEQ ID NO: 1022 - DNA, 20 bp, Artificial sequence
  Synthetic oligonucleotide
cagaaaccccttacctttat

SEQ ID NO: 1023 - DNA, 20 bp, Artificial sequence
  Synthetic oligonucleotide
tataattcaccatataccat

SEQ ID NO: 1024 - DNA, 20 bp, Artificial sequence
  Synthetic oligonucleotide
tccaaatcatcactgtgtgc

SEQ ID NO: 1025 - DNA, 20 bp, Artificial sequence
  Synthetic oligonucleotide
agagcagagacctatgacaa

SEQ ID NO: 1026 - DNA, 20 bp, Artificial sequence
  Synthetic oligonucleotide
tcatcaaatcaaaaatctct

SEQ ID NO: 1027 - DNA, 20 bp, Artificial sequence
  Synthetic oligonucleotide
acagatcaaacatccagaat

SEQ ID NO: 1028 - DNA, 20 bp, Artificial sequence
  Synthetic oligonucleotide
cttttagttcattatttaac

SEQ ID NO: 1029 - DNA, 20 bp, Artificial sequence
  Synthetic oligonucleotide
tgtaaaaatcatctttaatt

SEQ ID NO: 1030 - DNA, 20 bp, Artificial sequence
  Synthetic oligonucleotide
gcttgaacacttgcatcagt

SEQ ID NO: 1031 - DNA, 20 bp, Artificial sequence
  Synthetic oligonucleotide
cccagtgttccatcctccag

SEQ ID NO: 1032 - DNA, 20 bp, Artificial sequence
  Synthetic oligonucleotide
accatgaggctgcccccagc

SEQ ID NO: 1033 - DNA, 20 bp, Artificial sequence
  Synthetic oligonucleotide
gcttgattgtgatattgacg

SEQ ID NO: 1034 - DNA, 20 bp, Artificial sequence
  Synthetic oligonucleotide
aagagtgagacaccaccact

SEQ ID NO: 1035 - DNA, 20 bp, Artificial sequence
  Synthetic oligonucleotide
tccagattaaccaatggtta

SEQ ID NO: 1036 - DNA, 20 bp, Artificial sequence
  Synthetic oligonucleotide
tggaaaatatctctaaatag

SEQ ID NO: 1037 - DNA, 20 bp, Artificial sequence
  Synthetic oligonucleotide
agctaagaatctctaggatt

SEQ ID NO: 1038 - DNA, 20 bp, Artificial sequence
  Synthetic oligonucleotide
tgtgacaatatttactcttg

SEQ ID NO: 1039 - DNA, 20 bp, Artificial sequence
  Synthetic oligonucleotide
agttatgttcactgtgaata

SEQ ID NO: 1040 - DNA, 20 bp, Artificial sequence
  Synthetic oligonucleotide
atttcaagtcccagaagcct

SEQ ID NO: 1041 - DNA, 20 bp, Artificial sequence
  Synthetic oligonucleotide
gaggttgcctccaagggcac

SEQ ID NO: 1042 - DNA, 20 bp, Artificial sequence
  Synthetic oligonucleotide
caatttacttttcagctgcc

SEQ ID NO: 1043 - DNA, 20 bp, Artificial sequence
  Synthetic oligonucleotide
gtttccaggtaaatggacaa

SEQ ID NO: 1044 - DNA, 20 bp, Artificial sequence
  Synthetic oligonucleotide
ctttcacaactgcagctctc

SEQ ID NO: 1045 - DNA, 20 bp, Artificial sequence
  Synthetic oligonucleotide
ttaattacatcatcctctat

SEQ ID NO: 1046 - DNA, 20 bp, Artificial sequence
  Synthetic oligonucleotide
ttcttttctttgcacactga

SEQ ID NO: 1047 - DNA, 20 bp, Artificial sequence
  Synthetic oligonucleotide
gacctaattctggtttttga

SEQ ID NO: 1048 - DNA, 20 bp, Artificial sequence
  Synthetic oligonucleotide
tattctttgattcaaaagcc

SEQ ID NO: 1049 - DNA, 20 bp, Artificial sequence
  Synthetic oligonucleotide
ctaagatattttttagattg

SEQ ID NO: 1050 - DNA, 20 bp, Artificial sequence
  Synthetic oligonucleotide
aaatcaatcatatttctgtc

SEQ ID NO: 1051 - DNA, 20 bp, Artificial sequence
  Synthetic oligonucleotide
taattaacattaacagaatt

SEQ ID NO: 1052 - DNA, 20 bp, Artificial sequence
  Synthetic oligonucleotide
ctaggtgacaatatcaaaca

SEQ ID NO: 1053 - DNA, 20 bp, Artificial sequence
  Synthetic oligonucleotide
atagaatactcacaaagtgc

SEQ ID NO: 1054 - DNA, 20 bp, Artificial sequence
  Synthetic oligonucleotide
agttaatgcattagacactt

SEQ ID NO: 1055 - DNA, 20 bp, Artificial sequence
  Synthetic oligonucleotide
actttggattcttacatgaa

SEQ ID NO: 1056 - DNA, 20 bp, Artificial sequence
  Synthetic oligonucleotide
gatattaaacatttacaatt

SEQ ID NO: 1057 - DNA, 20 bp, Artificial sequence
  Synthetic oligonucleotide
aaaccgtgatgctctcagaa

SEQ ID NO: 1058 - DNA, 20 bp, Artificial sequence
  Synthetic oligonucleotide
aaaatccttaatcctattct

SEQ ID NO: 1059 - DNA, 20 bp, Artificial sequence
  Synthetic oligonucleotide
atatttatccaattccctgt

SEQ ID NO: 1060 - DNA, 20 bp, Artificial sequence
  Synthetic oligonucleotide
cctttcttctacaaatctaa

SEQ ID NO: 1061 - DNA, 20 bp, Artificial sequence
  Synthetic oligonucleotide
tgtaagaccttctctgtgtt

SEQ ID NO: 1062 - DNA, 20 bp, Artificial sequence
  Synthetic oligonucleotide
catacaaatcacatcctacc

SEQ ID NO: 1063 - DNA, 20 bp, Artificial sequence
  Synthetic oligonucleotide
tataatcttaatattttcct

SEQ ID NO: 1064 - DNA, 20 bp, Artificial sequence
  Synthetic oligonucleotide
tgtaaatgactcatcatttt

SEQ ID NO: 1065 - DNA, 20 bp, Artificial sequence
  Synthetic oligonucleotide
actattaattattttggtta

SEQ ID NO: 1066 - DNA, 20 bp, Artificial sequence
  Synthetic oligonucleotide
agctatcatttcctccattc

SEQ ID NO: 1067 - DNA, 20 bp, Artificial sequence
  Synthetic oligonucleotide
agattgcttaacaaaatgtt

SEQ ID NO: 1068 - DNA, 20 bp, Artificial sequence
  Synthetic oligonucleotide
ggtgttctaattttagatca

SEQ ID NO: 1069 - DNA, 20 bp, Artificial sequence
  Synthetic oligonucleotide
cataatgttcatttcagtta

SEQ ID NO: 1070 - DNA, 20 bp, Artificial sequence
  Synthetic oligonucleotide
tgtcagtttttccccacata

SEQ ID NO: 1071 - DNA, 20 bp, Artificial sequence
  Synthetic oligonucleotide
cctttcagatttttcacata

SEQ ID NO: 1072 - DNA, 20 bp, Artificial sequence
  Synthetic oligonucleotide
tgggtccatttcatctaaaa

SEQ ID NO: 1073 - DNA, 20 bp, Artificial sequence
  Synthetic oligonucleotide
ggttcagctaaactagattt

SEQ ID NO: 1074 - DNA, 20 bp, Artificial sequence
  Synthetic oligonucleotide
ggtgtcagtcacacagatgc

SEQ ID NO: 1075 - DNA, 20 bp, Artificial sequence
  Synthetic oligonucleotide
tgctcccttacataattcag

SEQ ID NO: 1076 - DNA, 20 bp, Artificial sequence
  Synthetic oligonucleotide
gagaatctttcaccttggtt

SEQ ID NO: 1077 - DNA, 20 bp, Artificial sequence
  Synthetic oligonucleotide
gctgtgagaattgctgcaca

SEQ ID NO: 1078 - DNA, 20 bp, Artificial sequence
  Synthetic oligonucleotide
atcttcaacatttataatgc

SEQ ID NO: 1079 - DNA, 20 bp, Artificial sequence
  Synthetic oligonucleotide
aaacacattacaacttgaag

SEQ ID NO: 1080 - DNA, 20 bp, Artificial sequence
  Synthetic oligonucleotide
tatttctttcctgatagttc

SEQ ID NO: 1081 - DNA, 20 bp, Artificial sequence
  Synthetic oligonucleotide
aacaacattaattatccccc

SEQ ID NO: 1082 - DNA, 20 bp, Artificial sequence
  Synthetic oligonucleotide
aagcattgtacctcaacaca

SEQ ID NO: 1083 - DNA, 20 bp, Artificial sequence
  Synthetic oligonucleotide
atcaagttttttttctaagc

SEQ ID NO: 1084 - DNA, 20 bp, Artificial sequence
  Synthetic oligonucleotide
gcaaataatctacaaagtaa

SEQ ID NO: 1085 - DNA, 20 bp, Artificial sequence
  Synthetic oligonucleotide
ctataaattcatctaggtat

SEQ ID NO: 1086 - DNA, 20 bp, Artificial sequence
  Synthetic oligonucleotide
aggagctctattaataggtt

SEQ ID NO: 1087 - DNA, 20 bp, Artificial sequence
  Synthetic oligonucleotide
atgagacatattttacagaa

SEQ ID NO: 1088 - DNA, 20 bp, Artificial sequence
  Synthetic oligonucleotide
gcttaacacacatttcaagt

SEQ ID NO: 1089 - DNA, 20 bp, Artificial sequence
  Synthetic oligonucleotide
gctgtcaaaaattatacact

SEQ ID NO: 1090 - DNA, 20 bp, Artificial sequence
  Synthetic oligonucleotide
tgaatttgattacatcctca

SEQ ID NO: 1091 - DNA, 20 bp, Artificial sequence
  Synthetic oligonucleotide
caatacctgtttattactaa

SEQ ID NO: 1092 - DNA, 20 bp, Artificial sequence
  Synthetic oligonucleotide
ctatgagctcttagagacac

SEQ ID NO: 1093 - DNA, 20 bp, Artificial sequence
  Synthetic oligonucleotide
tgggaaaacacatgttataa

SEQ ID NO: 1094 - DNA, 20 bp, Artificial sequence
  Synthetic oligonucleotide
ttgagatattatgttatttc

SEQ ID NO: 1095 - DNA, 20 bp, Artificial sequence
  Synthetic oligonucleotide
tcaatttttccaacatgacc

SEQ ID NO: 1096 - DNA, 20 bp, Artificial sequence
  Synthetic oligonucleotide
aaagggcttttatgtcagca

SEQ ID NO: 1097 - DNA, 20 bp, Artificial sequence
  Synthetic oligonucleotide
gtttatgtttctactaacat

SEQ ID NO: 1098 - DNA, 20 bp, Artificial sequence
  Synthetic oligonucleotide
aaaattatttttcatctcct

SEQ ID NO: 1099 - DNA, 20 bp, Artificial sequence
  Synthetic oligonucleotide
tcagaaaccccttaccttta

SEQ ID NO: 1100 - DNA, 20 bp, Artificial sequence
  Synthetic oligonucleotide
atataattcaccatatacca

SEQ ID NO: 1101 - DNA, 20 bp, Artificial sequence
  Synthetic oligonucleotide
gctccaaatcatcactgtgt

SEQ ID NO: 1102 - DNA, 20 bp, Artificial sequence
  Synthetic oligonucleotide
aagagcagagacctatgaca

SEQ ID NO: 1103 - DNA, 20 bp, Artificial sequence
  Synthetic oligonucleotide
ttcatcaaatcaaaaatctc

SEQ ID NO: 1104 - DNA, 20 bp, Artificial sequence
  Synthetic oligonucleotide
aacagatcaaacatccagaa

SEQ ID NO: 1105 - DNA, 20 bp, Artificial sequence
  Synthetic oligonucleotide
aatgacttttagttcattat

SEQ ID NO: 1106 - DNA, 20 bp, Artificial sequence
  Synthetic oligonucleotide
ctgtaaaaatcatctttaat

SEQ ID NO: 1107 - DNA, 20 bp, Artificial sequence
  Synthetic oligonucleotide
cgcttgaacacttgcatcag

SEQ ID NO: 1108 - DNA, 20 bp, Artificial sequence
  Synthetic oligonucleotide
ccccagtgttccatcctcca

SEQ ID NO: 1109 - DNA, 20 bp, Artificial sequence
  Synthetic oligonucleotide
agccaccaccatgaggctgc

SEQ ID NO: 1110 - DNA, 20 bp, Artificial sequence
  Synthetic oligonucleotide
agttctcccccttggtggtt

SEQ ID NO: 1111 - DNA, 20 bp, Artificial sequence
  Synthetic oligonucleotide
aaagagtgagacaccaccac

SEQ ID NO: 1112 - DNA, 20 bp, Artificial sequence
  Synthetic oligonucleotide
aaataagtccagattaacca

SEQ ID NO: 1113 - DNA, 20 bp, Artificial sequence
  Synthetic oligonucleotide
aatggaaaatatctctaaat

SEQ ID NO: 1114 - DNA, 20 bp, Artificial sequence
  Synthetic oligonucleotide
gagctaagaatctctaggat

SEQ ID NO: 1115 - DNA, 20 bp, Artificial sequence
  Synthetic oligonucleotide
ttgtgacaatatttactctt

SEQ ID NO: 1116 - DNA, 20 bp, Artificial sequence
  Synthetic oligonucleotide
cagttatgttcactgtgaat

SEQ ID NO: 1117 - DNA, 20 bp, Artificial sequence
  Synthetic oligonucleotide
ttgatttcaagtcccagaag

SEQ ID NO: 1118 - DNA, 20 bp, Artificial sequence
  Synthetic oligonucleotide
atgggaggttgcctccaagg

SEQ ID NO: 1119 - DNA, 20 bp, Artificial sequence
  Synthetic oligonucleotide
gcaatttacttttcagctgc

SEQ ID NO: 1120 - DNA, 20 bp, Artificial sequence
  Synthetic oligonucleotide
tggtttccaggtaaatggac

SEQ ID NO: 1121 - DNA, 20 bp, Artificial sequence
  Synthetic oligonucleotide
gctttcacaactgcagctct

SEQ ID NO: 1122 - DNA, 20 bp, Artificial sequence
  Synthetic oligonucleotide
tttaattacatcatcctcta

SEQ ID NO: 1123 - DNA, 20 bp, Artificial sequence
  Synthetic oligonucleotide
gttcttttctttgcacactg

SEQ ID NO: 1124 - DNA, 20 bp, Artificial sequence
  Synthetic oligonucleotide
cttgacctaattctggtttt

SEQ ID NO: 1125 - DNA, 20 bp, Artificial sequence
  Synthetic oligonucleotide
ctattctttgattcaaaagc

SEQ ID NO: 1126 - DNA, 20 bp, Artificial sequence
  Synthetic oligonucleotide
cctaagatattttttagatt

SEQ ID NO: 1127 - DNA, 20 bp, Artificial sequence
  Synthetic oligonucleotide
tcaaatcaatcatatttctg

SEQ ID NO: 1128 - DNA, 20 bp, Artificial sequence
  Synthetic oligonucleotide
actttaattaacattaacag

SEQ ID NO: 1129 - DNA, 20 bp, Artificial sequence
  Synthetic oligonucleotide
gctaggtgacaatatcaaac

SEQ ID NO: 1130 - DNA, 20 bp, Artificial sequence
  Synthetic oligonucleotide
acatagaatactcacaaagt

SEQ ID NO: 1131 - DNA, 20 bp, Artificial sequence
  Synthetic oligonucleotide
aaaagttaatgcattagaca

SEQ ID NO: 1132 - DNA, 20 bp, Artificial sequence
  Synthetic oligonucleotide
taatggtgtccactttggat

SEQ ID NO: 1133 - DNA, 20 bp, Artificial sequence
  Synthetic oligonucleotide
agatattaaacatttacaat

SEQ ID NO: 1134 - DNA, 20 bp, Artificial sequence
  Synthetic oligonucleotide
aactgctaattaaaccgtga

SEQ ID NO: 1135 - DNA, 20 bp, Artificial sequence
  Synthetic oligonucleotide
aaaaatccttaatcctattc

SEQ ID NO: 1136 - DNA, 20 bp, Artificial sequence
  Synthetic oligonucleotide
catatttatccaattccctg

SEQ ID NO: 1137 - DNA, 20 bp, Artificial sequence
  Synthetic oligonucleotide
ttcctttcttctacaaatct

SEQ ID NO: 1138 - DNA, 20 bp, Artificial sequence
  Synthetic oligonucleotide
ctgtaagaccttctctgtgt

SEQ ID NO: 1139 - DNA, 20 bp, Artificial sequence
  Synthetic oligonucleotide
acatacaaatcacatcctac

SEQ ID NO: 1140 - DNA, 20 bp, Artificial sequence
  Synthetic oligonucleotide
ttataatcttaatattttcc

SEQ ID NO: 1141 - DNA, 20 bp, Artificial sequence
  Synthetic oligonucleotide
gtgtaaatgactcatcattt

SEQ ID NO: 1142 - DNA, 20 bp, Artificial sequence
  Synthetic oligonucleotide
tactattaattattttggtt

SEQ ID NO: 1143 - DNA, 20 bp, Artificial sequence
  Synthetic oligonucleotide
tagctatcatttcctccatt

SEQ ID NO: 1144 - DNA, 20 bp, Artificial sequence
  Synthetic oligonucleotide
cagattgcttaacaaaatgt

SEQ ID NO: 1145 - DNA, 20 bp, Artificial sequence
  Synthetic oligonucleotide
aggtgttctaattttagatc

SEQ ID NO: 1146 - DNA, 20 bp, Artificial sequence
  Synthetic oligonucleotide
acataatgttcatttcagtt

SEQ ID NO: 1147 - DNA, 20 bp, Artificial sequence
  Synthetic oligonucleotide
ttgtcagtttttccccacat

SEQ ID NO: 1148 - DNA, 20 bp, Artificial sequence
  Synthetic oligonucleotide
ttcctttcagatttttcaca

SEQ ID NO: 1149 - DNA, 20 bp, Artificial sequence
  Synthetic oligonucleotide
ctgtgggtccatttcatcta

SEQ ID NO: 1150 - DNA, 20 bp, Artificial sequence
  Synthetic oligonucleotide
ggatatgtacaatctgttgt

SEQ ID NO: 1151 - DNA, 20 bp, Artificial sequence
  Synthetic oligonucleotide
aaatgatgatgcaatgaggt

SEQ ID NO: 1152 - DNA, 20 bp, Artificial sequence
  Synthetic oligonucleotide
aatggctgctcccttacata

SEQ ID NO: 1153 - DNA, 20 bp, Artificial sequence
  Synthetic oligonucleotide
agagaatctttcaccttggt

SEQ ID NO: 1154 - DNA, 20 bp, Artificial sequence
  Synthetic oligonucleotide
tcgacaaaaaaaattctcct

SEQ ID NO: 1155 - DNA, 20 bp, Artificial sequence
  Synthetic oligonucleotide
ctaatcttcaacatttataa

SEQ ID NO: 1156 - DNA, 20 bp, Artificial sequence
  Synthetic oligonucleotide
ccataaaacacattacaact

SEQ ID NO: 1157 - DNA, 20 bp, Artificial sequence
  Synthetic oligonucleotide
tttatttctttcctgatagt

SEQ ID NO: 1158 - DNA, 20 bp, Artificial sequence
  Synthetic oligonucleotide
taacaacattaattatcccc

SEQ ID NO: 1159 - DNA, 20 bp, Artificial sequence
  Synthetic oligonucleotide
agaagcattgtacctcaaca

SEQ ID NO: 1160 - DNA, 20 bp, Artificial sequence
  Synthetic oligonucleotide
tatcaagttttttttctaag

SEQ ID NO: 1161 - DNA, 20 bp, Artificial sequence
  Synthetic oligonucleotide
cagcaaataatctacaaagt

SEQ ID NO: 1162 - DNA, 20 bp, Artificial sequence
  Synthetic oligonucleotide
tctataaattcatctaggta

SEQ ID NO: 1163 - DNA, 20 bp, Artificial sequence
  Synthetic oligonucleotide
tggttgaaaatcaggagctc

SEQ ID NO: 1164 - DNA, 20 bp, Artificial sequence
  Synthetic oligonucleotide
gtctacaaaacattttttct

SEQ ID NO: 1165 - DNA, 20 bp, Artificial sequence
  Synthetic oligonucleotide
tagcttaacacacatttcaa

SEQ ID NO: 1166 - DNA, 20 bp, Artificial sequence
  Synthetic oligonucleotide
cagccagtatgtgtcagctt

SEQ ID NO: 1167 - DNA, 20 bp, Artificial sequence
  Synthetic oligonucleotide
gatgaatttgattacatcct

SEQ ID NO: 1168 - DNA, 20 bp, Artificial sequence
  Synthetic oligonucleotide
gtcaatacctgtttattact

SEQ ID NO: 1169 - DNA, 20 bp, Artificial sequence
  Synthetic oligonucleotide
atctatgagctcttagagac

SEQ ID NO: 1170 - DNA, 20 bp, Artificial sequence
  Synthetic oligonucleotide
gaatgggaaaacacatgtta

SEQ ID NO: 1171 - DNA, 20 bp, Artificial sequence
  Synthetic oligonucleotide
cttgagatattatgttattt

SEQ ID NO: 1172 - DNA, 20 bp, Artificial sequence
  Synthetic oligonucleotide
ctcaatttttccaacatgac

SEQ ID NO: 1173 - DNA, 20 bp, Artificial sequence
  Synthetic oligonucleotide
tctaaagggcttttatgtca

SEQ ID NO: 1174 - DNA, 20 bp, Artificial sequence
  Synthetic oligonucleotide
tgtttatgtttctactaaca

SEQ ID NO: 1175 - DNA, 20 bp, Artificial sequence
  Synthetic oligonucleotide
gaaaattatttttcatctcc

SEQ ID NO: 1176 - DNA, 20 bp, Artificial sequence
  Synthetic oligonucleotide
ctcagaaaccccttaccttt

SEQ ID NO: 1177 - DNA, 20 bp, Artificial sequence
  Synthetic oligonucleotide
catataattcaccatatacc

SEQ ID NO: 1178 - DNA, 20 bp, Artificial sequence
  Synthetic oligonucleotide
ggctccaaatcatcactgtg

SEQ ID NO: 1179 - DNA, 20 bp, Artificial sequence
  Synthetic oligonucleotide
cacttagctccaagagcaga

SEQ ID NO: 1180 - DNA, 20 bp, Artificial sequence
  Synthetic oligonucleotide
cattcatcaaatcaaaaatc

SEQ ID NO: 1181 - DNA, 20 bp, Artificial sequence
  Synthetic oligonucleotide
aaacagatcaaacatccaga

SEQ ID NO: 1182 - DNA, 20 bp, Artificial sequence
  Synthetic oligonucleotide
gaatgacttttagttcatta

SEQ ID NO: 1183 - DNA, 20 bp, Artificial sequence
  Synthetic oligonucleotide
actgtaaaaatcatctttaa

SEQ ID NO: 1184 - DNA, 20 bp, Artificial sequence
  Synthetic oligonucleotide
tcgcttgaacacttgcatca

SEQ ID NO: 1185 - DNA, 20 bp, Artificial sequence
  Synthetic oligonucleotide
tcggctgcccccagtgttcc

SEQ ID NO: 1186 - DNA, 20 bp, Artificial sequence
  Synthetic oligonucleotide
cagccaccaccatgaggctg

SEQ ID NO: 1187 - DNA, 20 bp, Artificial sequence
  Synthetic oligonucleotide
tgaagttctcccccttggtg

SEQ ID NO: 1188 - DNA, 20 bp, Artificial sequence
  Synthetic oligonucleotide
tgattagcctatccgggaca

SEQ ID NO: 1189 - DNA, 20 bp, Artificial sequence
  Synthetic oligonucleotide
gtccaaaaataagtccagat

SEQ ID NO: 1190 - DNA, 20 bp, Artificial sequence
  Synthetic oligonucleotide
ttaaaatggaaaatatctct

SEQ ID NO: 1191 - DNA, 20 bp, Artificial sequence
  Synthetic oligonucleotide
agagctaagaatctctagga

SEQ ID NO: 1192 - DNA, 20 bp, Artificial sequence
  Synthetic oligonucleotide
gttgtgacaatatttactct

SEQ ID NO: 1193 - DNA, 20 bp, Artificial sequence
  Synthetic oligonucleotide
tacagttatgttcactgtga

SEQ ID NO: 1194 - DNA, 20 bp, Artificial sequence
  Synthetic oligonucleotide
tttgatttcaagtcccagaa

SEQ ID NO: 1195 - DNA, 20 bp, Artificial sequence
  Synthetic oligonucleotide
tttaaacatctaaaatggga

SEQ ID NO: 1196 - DNA, 20 bp, Artificial sequence
  Synthetic oligonucleotide
ggcaatttacttttcagctg

SEQ ID NO: 1197 - DNA, 20 bp, Artificial sequence
  Synthetic oligonucleotide
tcattctggtttccaggtaa

SEQ ID NO: 1198 - DNA, 20 bp, Artificial sequence
  Synthetic oligonucleotide
tgctttcacaactgcagctc

SEQ ID NO: 1199 - DNA, 20 bp, Artificial sequence
  Synthetic oligonucleotide
ttttaattacatcatcctct

SEQ ID NO: 1200 - DNA, 20 bp, Artificial sequence
  Synthetic oligonucleotide
agttcttttctttgcacact

SEQ ID NO: 1201 - DNA, 20 bp, Artificial sequence
  Synthetic oligonucleotide
acttgacctaattctggttt

SEQ ID NO: 1202 - DNA, 20 bp, Artificial sequence
  Synthetic oligonucleotide
cctattctttgattcaaaag

SEQ ID NO: 1203 - DNA, 20 bp, Artificial sequence
  Synthetic oligonucleotide
acctaagatattttttagat

SEQ ID NO: 1204 - DNA, 20 bp, Artificial sequence
  Synthetic oligonucleotide
ttcaaatcaatcatatttct

SEQ ID NO: 1205 - DNA, 20 bp, Artificial sequence
  Synthetic oligonucleotide
tactttaattaacattaaca

SEQ ID NO: 1206 - DNA, 20 bp, Artificial sequence
  Synthetic oligonucleotide
tgctaggtgacaatatcaaa

SEQ ID NO: 1207 - DNA, 20 bp, Artificial sequence
  Synthetic oligonucleotide
ttacatagaatactcacaaa

SEQ ID NO: 1208 - DNA, 20 bp, Artificial sequence
  Synthetic oligonucleotide
cttacaaaagttaatgcatt

SEQ ID NO: 1209 - DNA, 20 bp, Artificial sequence
  Synthetic oligonucleotide
catgcatatttcaaagacct

SEQ ID NO: 1210 - DNA, 20 bp, Artificial sequence
  Synthetic oligonucleotide
cagatattaaacatttacaa

SEQ ID NO: 1211 - DNA, 20 bp, Artificial sequence
  Synthetic oligonucleotide
gaactgctaattaaaccgtg

SEQ ID NO: 1212 - DNA, 20 bp, Artificial sequence
  Synthetic oligonucleotide
gtaaaaatccttaatcctat

SEQ ID NO: 1213 - DNA, 20 bp, Artificial sequence
  Synthetic oligonucleotide
acatatttatccaattccct

SEQ ID NO: 1214 - DNA, 20 bp, Artificial sequence
  Synthetic oligonucleotide
tttttcctttcttctacaaa

SEQ ID NO: 1215 - DNA, 20 bp, Artificial sequence
  Synthetic oligonucleotide
actgtaagaccttctctgtg

SEQ ID NO: 1216 - DNA, 20 bp, Artificial sequence
  Synthetic oligonucleotide
aacatacaaatcacatccta

SEQ ID NO: 1217 - DNA, 20 bp, Artificial sequence
  Synthetic oligonucleotide
ctattataatcttaatattt

SEQ ID NO: 1218 - DNA, 20 bp, Artificial sequence
  Synthetic oligonucleotide
ttgtgtaaatgactcatcat

SEQ ID NO: 1219 - DNA, 20 bp, Artificial sequence
  Synthetic oligonucleotide
ttactattaattattttggt

SEQ ID NO: 1220 - DNA, 20 bp, Artificial sequence
  Synthetic oligonucleotide
agtagctatcatttcctcca

SEQ ID NO: 1221 - DNA, 20 bp, Artificial sequence
  Synthetic oligonucleotide
tcaccagattgcttaacaaa

SEQ ID NO: 1222 - DNA, 20 bp, Artificial sequence
  Synthetic oligonucleotide
caggtgttctaattttagat

SEQ ID NO: 1223 - DNA, 20 bp, Artificial sequence
  Synthetic oligonucleotide
tacataatgttcatttcagt

SEQ ID NO: 1224 - DNA, 20 bp, Artificial sequence
  Synthetic oligonucleotide
cttgtcagtttttccccaca

SEQ ID NO: 1225 - DNA, 20 bp, Artificial sequence
  Synthetic oligonucleotide
gcttttcctttcagattttt

SEQ ID NO: 1226 - DNA, 20 bp, Artificial sequence
  Synthetic oligonucleotide
actgtgggtccatttcatct

SEQ ID NO: 1227 - DNA, 20 bp, Artificial sequence
  Synthetic oligonucleotide
caggatatgtacaatctgtt

SEQ ID NO: 1228 - DNA, 20 bp, Artificial sequence
  Synthetic oligonucleotide
gctgattttacaagaaatga

SEQ ID NO: 1229 - DNA, 20 bp, Artificial sequence
  Synthetic oligonucleotide
ttgattacattatttttaaa

SEQ ID NO: 1230 - DNA, 20 bp, Artificial sequence
  Synthetic oligonucleotide
ttcagagaatctttcacctt

SEQ ID NO: 1231 - DNA, 20 bp, Artificial sequence
  Synthetic oligonucleotide
atggttaacacatcgacaaa

SEQ ID NO: 1232 - DNA, 20 bp, Artificial sequence
  Synthetic oligonucleotide
ggtctaatcttcaacattta

SEQ ID NO: 1233 - DNA, 20 bp, Artificial sequence
  Synthetic oligonucleotide
gcccataaaacacattacaa

SEQ ID NO: 1234 - DNA, 20 bp, Artificial sequence
  Synthetic oligonucleotide
ctttttatttctttcctgat

SEQ ID NO: 1235 - DNA, 20 bp, Artificial sequence
  Synthetic oligonucleotide
ttaacaacattaattatccc

SEQ ID NO: 1236 - DNA, 20 bp, Artificial sequence
  Synthetic oligonucleotide
tgtagaagcattgtacctca

SEQ ID NO: 1237 - DNA, 20 bp, Artificial sequence
  Synthetic oligonucleotide
gtatcaagttttttttctaa

SEQ ID NO: 1238 - DNA, 20 bp, Artificial sequence
  Synthetic oligonucleotide
ccagcaaataatctacaaag

SEQ ID NO: 1239 - DNA, 20 bp, Artificial sequence
  Synthetic oligonucleotide
tgttctataaattcatctag

SEQ ID NO: 1240 - DNA, 20 bp, Artificial sequence
  Synthetic oligonucleotide
agaatggttgaaaatcagga

SEQ ID NO: 1241 - DNA, 20 bp, Artificial sequence
  Synthetic oligonucleotide
atcatagaatgttttttcaa

SEQ ID NO: 1242 - DNA, 20 bp, Artificial sequence
  Synthetic oligonucleotide
ttagcttaacacacatttca

SEQ ID NO: 1243 - DNA, 20 bp, Artificial sequence
  Synthetic oligonucleotide
ttgttgtttcttttctggta

SEQ ID NO: 1244 - DNA, 20 bp, Artificial sequence
  Synthetic oligonucleotide
ggaagaactttttaaacaaa

SEQ ID NO: 1245 - DNA, 20 bp, Artificial sequence
  Synthetic oligonucleotide
tggtcaatacctgtttatta

SEQ ID NO: 1246 - DNA, 20 bp, Artificial sequence
  Synthetic oligonucleotide
ttgaatgtgcctcatttaaa

SEQ ID NO: 1247 - DNA, 20 bp, Artificial sequence
  Synthetic oligonucleotide
tgaatgggaaaacacatgtt

SEQ ID NO: 1248 - DNA, 20 bp, Artificial sequence
  Synthetic oligonucleotide
acttgagatattatgttatt

SEQ ID NO: 1249 - DNA, 20 bp, Artificial sequence
  Synthetic oligonucleotide
cttctcaatttttccaacat

SEQ ID NO: 1250 - DNA, 20 bp, Artificial sequence
  Synthetic oligonucleotide
tcagtagctttcagtctaaa

SEQ ID NO: 1251 - DNA, 20 bp, Artificial sequence
  Synthetic oligonucleotide
ctgtttatgtttctactaac

SEQ ID NO: 1252 - DNA, 20 bp, Artificial sequence
  Synthetic oligonucleotide
tagaaaattatttttcatct

SEQ ID NO: 1253 - DNA, 20 bp, Artificial sequence
  Synthetic oligonucleotide
actcagaaaccccttacctt

SEQ ID NO: 1254 - DNA, 20 bp, Artificial sequence
  Synthetic oligonucleotide
ccatataattcaccatatac

SEQ ID NO: 1255 - DNA, 20 bp, Artificial sequence
  Synthetic oligonucleotide
taggctccaaatcatcactg

SEQ ID NO: 1256 - DNA, 20 bp, Artificial sequence
  Synthetic oligonucleotide
ctgggcacttagctccaaga

SEQ ID NO: 1257 - DNA, 20 bp, Artificial sequence
  Synthetic oligonucleotide
acattcatcaaatcaaaaat

SEQ ID NO: 1258 - DNA, 20 bp, Artificial sequence
  Synthetic oligonucleotide
caaacagatcaaacatccag

SEQ ID NO: 1259 - DNA, 20 bp, Artificial sequence
  Synthetic oligonucleotide
tgaatgacttttagttcatt

SEQ ID NO: 1260 - DNA, 20 bp, Artificial sequence
  Synthetic oligonucleotide
gactgtaaaaatcatcttta

SEQ ID NO: 1261 - DNA, 20 bp, Artificial sequence
  Synthetic oligonucleotide
attcgcttgaacacttgcat

SEQ ID NO: 1262 - DNA, 20 bp, Artificial sequence
  Synthetic oligonucleotide
cccccagccaccaccgccct

SEQ ID NO: 1263 - DNA, 20 bp, Artificial sequence
  Synthetic oligonucleotide
ctgtccccagccaccaccat

SEQ ID NO: 1264 - DNA, 20 bp, Artificial sequence
  Synthetic oligonucleotide
acgcgctccatcatcttaac

SEQ ID NO: 1265 - DNA, 20 bp, Artificial sequence
  Synthetic oligonucleotide
ttgattagcctatccgggac

SEQ ID NO: 1266 - DNA, 20 bp, Artificial sequence
  Synthetic oligonucleotide
taagtccaaaaataagtcca

SEQ ID NO: 1267 - DNA, 20 bp, Artificial sequence
  Synthetic oligonucleotide
cttaaaatggaaaatatctc

SEQ ID NO: 1268 - DNA, 20 bp, Artificial sequence
  Synthetic oligonucleotide
atcaccccagttctcggtac

SEQ ID NO: 1269 - DNA, 20 bp, Artificial sequence
  Synthetic oligonucleotide
tgttgtgacaatatttactc

SEQ ID NO: 1270 - DNA, 20 bp, Artificial sequence
  Synthetic oligonucleotide
ttacagttatgttcactgtg

SEQ ID NO: 1271 - DNA, 20 bp, Artificial sequence
  Synthetic oligonucleotide
atttgatttcaagtcccaga

SEQ ID NO: 1272 - DNA, 20 bp, Artificial sequence
  Synthetic oligonucleotide
gtcctttaaacatctaaaat

SEQ ID NO: 1273 - DNA, 20 bp, Artificial sequence
  Synthetic oligonucleotide
aggcaatttacttttcagct

SEQ ID NO: 1274 - DNA, 20 bp, Artificial sequence
  Synthetic oligonucleotide
atcattctggtttccaggta

SEQ ID NO: 1275 - DNA, 20 bp, Artificial sequence
  Synthetic oligonucleotide
gtgctttcacaactgcagct

SEQ ID NO: 1276 - DNA, 20 bp, Artificial sequence
  Synthetic oligonucleotide
tttttaattacatcatcctc

SEQ ID NO: 1277 - DNA, 20 bp, Artificial sequence
  Synthetic oligonucleotide
cagttcttttctttgcacac

SEQ ID NO: 1278 - DNA, 20 bp, Artificial sequence
  Synthetic oligonucleotide
aacttgacctaattctggtt

SEQ ID NO: 1279 - DNA, 20 bp, Artificial sequence
  Synthetic oligonucleotide
ccctattctttgattcaaaa

SEQ ID NO: 1280 - DNA, 20 bp, Artificial sequence
  Synthetic oligonucleotide
tctccaacctaagatatttt

SEQ ID NO: 1281 - DNA, 20 bp, Artificial sequence
  Synthetic oligonucleotide
cttcaaatcaatcatatttc

SEQ ID NO: 1282 - DNA, 20 bp, Artificial sequence
  Synthetic oligonucleotide
ttactttaattaacattaac

SEQ ID NO: 1283 - DNA, 20 bp, Artificial sequence
  Synthetic oligonucleotide
ctgctaggtgacaatatcaa

SEQ ID NO: 1284 - DNA, 20 bp, Artificial sequence
  Synthetic oligonucleotide
ttttacatagaatactcaca

SEQ ID NO: 1285 - DNA, 20 bp, Artificial sequence
  Synthetic oligonucleotide
taccttacaaaagttaatgc

SEQ ID NO: 1286 - DNA, 20 bp, Artificial sequence
  Synthetic oligonucleotide
acatgcatatttcaaagacc

SEQ ID NO: 1287 - DNA, 20 bp, Artificial sequence
  Synthetic oligonucleotide
tcagatattaaacatttaca

SEQ ID NO: 1288 - DNA, 20 bp, Artificial sequence
  Synthetic oligonucleotide
aaacacttcaaatcatatgg

SEQ ID NO: 1289 - DNA, 20 bp, Artificial sequence
  Synthetic oligonucleotide
tgtaaaaatccttaatccta

SEQ ID NO: 1290 - DNA, 20 bp, Artificial sequence
  Synthetic oligonucleotide
aacatatttatccaattccc

SEQ ID NO: 1291 - DNA, 20 bp, Artificial sequence
  Synthetic oligonucleotide
gattttttcctttcttctac

SEQ ID NO: 1292 - DNA, 20 bp, Artificial sequence
  Synthetic oligonucleotide
ttcactgtaagaccttctct

SEQ ID NO: 1293 - DNA, 20 bp, Artificial sequence
  Synthetic oligonucleotide
taacatacaaatcacatcct

SEQ ID NO: 1294 - DNA, 20 bp, Artificial sequence
  Synthetic oligonucleotide
tctattataatcttaatatt

SEQ ID NO: 1295 - DNA, 20 bp, Artificial sequence
  Synthetic oligonucleotide
ttttattgtgtaaatgactc

SEQ ID NO: 1296 - DNA, 20 bp, Artificial sequence
  Synthetic oligonucleotide
gctgttactattaattattt

SEQ ID NO: 1297 - DNA, 20 bp, Artificial sequence
  Synthetic oligonucleotide
aagtagctatcatttcctcc

SEQ ID NO: 1298 - DNA, 20 bp, Artificial sequence
  Synthetic oligonucleotide
atcaccagattgcttaacaa

SEQ ID NO: 1299 - DNA, 20 bp, Artificial sequence
  Synthetic oligonucleotide
tttccaggtgttctaatttt

SEQ ID NO: 1300 - DNA, 20 bp, Artificial sequence
  Synthetic oligonucleotide
gttacataatgttcatttca

SEQ ID NO: 1301 - DNA, 20 bp, Artificial sequence
  Synthetic oligonucleotide
acttgtcagtttttccccac

SEQ ID NO: 1302 - DNA, 20 bp, Artificial sequence
  Synthetic oligonucleotide
tgtgcttttcctttcagatt

SEQ ID NO: 1303 - DNA, 20 bp, Artificial sequence
  Synthetic oligonucleotide
cctttctcttacagaaaact

SEQ ID NO: 1304 - DNA, 20 bp, Artificial sequence
  Synthetic oligonucleotide
ctttcaaccttcctaagacc

SEQ ID NO: 1305 - DNA, 20 bp, Artificial sequence
  Synthetic oligonucleotide
aagctgattttacaagaaat

SEQ ID NO: 1306 - DNA, 20 bp, Artificial sequence
  Synthetic oligonucleotide
atttgattacattattttta

SEQ ID NO: 1307 - DNA, 20 bp, Artificial sequence
  Synthetic oligonucleotide
gttcagagaatctttcacct

SEQ ID NO: 1308 - DNA, 20 bp, Artificial sequence
  Synthetic oligonucleotide
aatggttaacacatcgacaa

SEQ ID NO: 1309 - DNA, 20 bp, Artificial sequence
  Synthetic oligonucleotide
caggcttcagtgctaggtcc

SEQ ID NO: 1310 - DNA, 20 bp, Artificial sequence
  Synthetic oligonucleotide
gagatccaaatataggcact

SEQ ID NO: 1311 - DNA, 20 bp, Artificial sequence
  Synthetic oligonucleotide
tggcactttctttttatttc

SEQ ID NO: 1312 - DNA, 20 bp, Artificial sequence
  Synthetic oligonucleotide
ttctatggaatctgtaggtc

SEQ ID NO: 1313 - DNA, 20 bp, Artificial sequence
  Synthetic oligonucleotide
gagacaataaccatacgatc

SEQ ID NO: 1314 - DNA, 20 bp, Artificial sequence
  Synthetic oligonucleotide
catggagcatgctccaagac

SEQ ID NO: 1315 - DNA, 20 bp, Artificial sequence
  Synthetic oligonucleotide
gtcaccagcaaataatctac

SEQ ID NO: 1316 - DNA, 20 bp, Artificial sequence
  Synthetic oligonucleotide
ttgttctataaattcatcta

SEQ ID NO: 1317 - DNA, 20 bp, Artificial sequence
  Synthetic oligonucleotide
aagaagaatacattatgacc

SEQ ID NO: 1318 - DNA, 20 bp, Artificial sequence
  Synthetic oligonucleotide
acatcatagaatgttttttc

SEQ ID NO: 1319 - DNA, 20 bp, Artificial sequence
  Synthetic oligonucleotide
attagcttaacacacatttc

SEQ ID NO: 1320 - DNA, 20 bp, Artificial sequence
  Synthetic oligonucleotide
gttgttgtttcttttctggt

SEQ ID NO: 1321 - DNA, 20 bp, Artificial sequence
  Synthetic oligonucleotide
ggtgacacattatacagaga

SEQ ID NO: 1322 - DNA, 20 bp, Artificial sequence
  Synthetic oligonucleotide
atggtcaatacctgtttatt

SEQ ID NO: 1323 - DNA, 20 bp, Artificial sequence
  Synthetic oligonucleotide
aaacatttatttcatgtgcc

SEQ ID NO: 1324 - DNA, 20 bp, Artificial sequence
  Synthetic oligonucleotide
atgaatgggaaaacacatgt

SEQ ID NO: 1325 - DNA, 20 bp, Artificial sequence
  Synthetic oligonucleotide
ctacttgagatattatgtta

SEQ ID NO: 1326 - DNA, 20 bp, Artificial sequence
  Synthetic oligonucleotide
agcttctcaatttttccaac

SEQ ID NO: 1327 - DNA, 20 bp, Artificial sequence
  Synthetic oligonucleotide
agtcagtagctttcagtcta

SEQ ID NO: 1328 - DNA, 20 bp, Artificial sequence
  Synthetic oligonucleotide
tcctgtttatgtttctacta

SEQ ID NO: 1329 - DNA, 20 bp, Artificial sequence
  Synthetic oligonucleotide
tgcaaatttttctaaaaatt

SEQ ID NO: 1330 - DNA, 20 bp, Artificial sequence
  Synthetic oligonucleotide
gaactcagaaaccccttacc

SEQ ID NO: 1331 - DNA, 20 bp, Artificial sequence
  Synthetic oligonucleotide
accatataattcaccatata

SEQ ID NO: 1332 - DNA, 20 bp, Artificial sequence
  Synthetic oligonucleotide
cataggctccaaatcatcac

SEQ ID NO: 1333 - DNA, 20 bp, Artificial sequence
  Synthetic oligonucleotide
tctcatttaccctgggcact

SEQ ID NO: 1334 - DNA, 20 bp, Artificial sequence
  Synthetic oligonucleotide
gtacattcatcaaatcaaaa

SEQ ID NO: 1335 - DNA, 20 bp, Artificial sequence
  Synthetic oligonucleotide
acaaacagatcaaacatcca

SEQ ID NO: 1336 - DNA, 20 bp, Artificial sequence
  Synthetic oligonucleotide
gatgaatgacttttagttca

SEQ ID NO: 1337 - DNA, 20 bp, Artificial sequence
  Synthetic oligonucleotide
tgactgtaaaaatcatcttt

SEQ ID NO: 1338 - DNA, 20 bp, Artificial sequence
  Synthetic oligonucleotide
agattcgcttgaacacttgc

SEQ ID NO: 1339 - DNA, 20 bp, Artificial sequence
  Synthetic oligonucleotide
gcccccagccaccaccgccc

SEQ ID NO: 1340 - DNA, 20 bp, Artificial sequence
  Synthetic oligonucleotide
ccagccaccaccatgaggct

SEQ ID NO: 1341 - DNA, 20 bp, Artificial sequence
  Synthetic oligonucleotide
cacgcgctccatcatcttaa

SEQ ID NO: 1342 - DNA, 20 bp, Artificial sequence
  Synthetic oligonucleotide
attgattagcctatccggga

SEQ ID NO: 1343 - DNA, 20 bp, Artificial sequence
  Synthetic oligonucleotide
actaagtccaaaaataagtc

SEQ ID NO: 1344 - DNA, 20 bp, Artificial sequence
  Synthetic oligonucleotide
gttttcttaaaatggaaaat

SEQ ID NO: 1345 - DNA, 20 bp, Artificial sequence
  Synthetic oligonucleotide
agtaaaacatcaccccagtt

SEQ ID NO: 1346 - DNA, 20 bp, Artificial sequence
  Synthetic oligonucleotide
gtgttgtgacaatatttact

SEQ ID NO: 1347 - DNA, 20 bp, Artificial sequence
  Synthetic oligonucleotide
gttacagttatgttcactgt

SEQ ID NO: 1348 - DNA, 20 bp, Artificial sequence
  Synthetic oligonucleotide
catttgatttcaagtcccag

SEQ ID NO: 1349 - DNA, 20 bp, Artificial sequence
  Synthetic oligonucleotide
ggtcctttaaacatctaaaa

SEQ ID NO: 1350 - DNA, 20 bp, Artificial sequence
  Synthetic oligonucleotide
aaggcaatttacttttcagc

SEQ ID NO: 1351 - DNA, 20 bp, Artificial sequence
  Synthetic oligonucleotide
aatcattctggtttccaggt

SEQ ID NO: 1352 - DNA, 20 bp, Artificial sequence
  Synthetic oligonucleotide
tggtgctttcacaactgcag

SEQ ID NO: 1353 - DNA, 20 bp, Artificial sequence
  Synthetic oligonucleotide
ttttttaattacatcatcct

SEQ ID NO: 1354 - DNA, 20 bp, Artificial sequence
  Synthetic oligonucleotide
gcagttcttttctttgcaca

SEQ ID NO: 1355 - DNA, 20 bp, Artificial sequence
  Synthetic oligonucleotide
gaacttgacctaattctggt

SEQ ID NO: 1356 - DNA, 20 bp, Artificial sequence
  Synthetic oligonucleotide
tccctattctttgattcaaa

SEQ ID NO: 1357 - DNA, 20 bp, Artificial sequence
  Synthetic oligonucleotide
catctccaacctaagatatt

SEQ ID NO: 1358 - DNA, 20 bp, Artificial sequence
  Synthetic oligonucleotide
acttcaaatcaatcatattt

SEQ ID NO: 1359 - DNA, 20 bp, Artificial sequence
  Synthetic oligonucleotide
ttttactttaattaacatta

SEQ ID NO: 1360 - DNA, 20 bp, Artificial sequence
  Synthetic oligonucleotide
acatatctgctaggtgacaa

SEQ ID NO: 1361 - DNA, 20 bp, Artificial sequence
  Synthetic oligonucleotide
ctatgcaatatatattttat

SEQ ID NO: 1362 - DNA, 20 bp, Artificial sequence
  Synthetic oligonucleotide
cagtaccttacaaaagttaa

SEQ ID NO: 1363 - DNA, 20 bp, Artificial sequence
  Synthetic oligonucleotide
tacatgcatatttcaaagac

SEQ ID NO: 1364 - DNA, 20 bp, Artificial sequence
  Synthetic oligonucleotide
gtcagatattaaacatttac

SEQ ID NO: 1365 - DNA, 20 bp, Artificial sequence
  Synthetic oligonucleotide
gggaaacacttcaaatcata

SEQ ID NO: 1366 - DNA, 20 bp, Artificial sequence
  Synthetic oligonucleotide
ttgtaaaaatccttaatcct

SEQ ID NO: 1367 - DNA, 20 bp, Artificial sequence
  Synthetic oligonucleotide
taacatatttatccaattcc

SEQ ID NO: 1368 - DNA, 20 bp, Artificial sequence
  Synthetic oligonucleotide
gtgattttttcctttcttct

SEQ ID NO: 1369 - DNA, 20 bp, Artificial sequence
  Synthetic oligonucleotide
ctttttttcactgtaagacc

SEQ ID NO: 1370 - DNA, 20 bp, Artificial sequence
  Synthetic oligonucleotide
ataacatacaaatcacatcc

SEQ ID NO: 1371 - DNA, 20 bp, Artificial sequence
  Synthetic oligonucleotide
atctattataatcttaatat

SEQ ID NO: 1372 - DNA, 20 bp, Artificial sequence
  Synthetic oligonucleotide
atttgcattttattgtgtaa

SEQ ID NO: 1373 - DNA, 20 bp, Artificial sequence
  Synthetic oligonucleotide
tgctgttactattaattatt

SEQ ID NO: 1374 - DNA, 20 bp, Artificial sequence
  Synthetic oligonucleotide
aaagtagctatcatttcctc

SEQ ID NO: 1375 - DNA, 20 bp, Artificial sequence
  Synthetic oligonucleotide
tcttaatgcatcaccagatt

SEQ ID NO: 1376 - DNA, 20 bp, Artificial sequence
  Synthetic oligonucleotide
taggctcttttccaggtgtt

SEQ ID NO: 1377 - DNA, 20 bp, Artificial sequence
  Synthetic oligonucleotide
ggttacataatgttcatttc

SEQ ID NO: 1378 - DNA, 20 bp, Artificial sequence
  Synthetic oligonucleotide
tacttgtcagtttttcccca

SEQ ID NO: 1379 - DNA, 20 bp, Artificial sequence
  Synthetic oligonucleotide
tctgtgcttttcctttcaga

SEQ ID NO: 1380 - DNA, 20 bp, Artificial sequence
  Synthetic oligonucleotide
aacaatctctcctttctctt

SEQ ID NO: 1381 - DNA, 20 bp, Artificial sequence
  Synthetic oligonucleotide
actttcaaccttcctaagac

SEQ ID NO: 1382 - DNA, 20 bp, Artificial sequence
  Synthetic oligonucleotide
taagctgattttacaagaaa

SEQ ID NO: 1383 - DNA, 20 bp, Artificial sequence
  Synthetic oligonucleotide
gttatttgattacattattt

SEQ ID NO: 1384 - DNA, 20 bp, Artificial sequence
  Synthetic oligonucleotide
agttcagagaatctttcacc

SEQ ID NO: 1385 - DNA, 20 bp, Artificial sequence
  Synthetic oligonucleotide
gaatggttaacacatcgaca

SEQ ID NO: 1386 - DNA, 20 bp, Artificial sequence
  Synthetic oligonucleotide
ccgtgatcaggcttcagtgc

SEQ ID NO: 1387 - DNA, 20 bp, Artificial sequence
  Synthetic oligonucleotide
tgagatccaaatataggcac

SEQ ID NO: 1388 - DNA, 20 bp, Artificial sequence
  Synthetic oligonucleotide
aatggcactttctttttatt

SEQ ID NO: 1389 - DNA, 20 bp, Artificial sequence
  Synthetic oligonucleotide
atagggattctatggaatct

SEQ ID NO: 1390 - DNA, 20 bp, Artificial sequence
  Synthetic oligonucleotide
acagagtgagacaataacca

SEQ ID NO: 1391 - DNA, 20 bp, Artificial sequence
  Synthetic oligonucleotide
aatacaggacattccatcca

SEQ ID NO: 1392 - DNA, 20 bp, Artificial sequence
  Synthetic oligonucleotide
gcaagctacaaaattttact

SEQ ID NO: 1393 - DNA, 20 bp, Artificial sequence
  Synthetic oligonucleotide
ttgcttttatgctattaggt

SEQ ID NO: 1394 - DNA, 20 bp, Artificial sequence
  Synthetic oligonucleotide
caacttattttaacagttta

SEQ ID NO: 1395 - DNA, 20 bp, Artificial sequence
  Synthetic oligonucleotide
ggacagtaacatcatagaat

SEQ ID NO: 1396 - DNA, 20 bp, Artificial sequence
  Synthetic oligonucleotide
gattagcttaacacacattt

SEQ ID NO: 1397 - DNA, 20 bp, Artificial sequence
  Synthetic oligonucleotide
ggattgtctttctattaaga

SEQ ID NO: 1398 - DNA, 20 bp, Artificial sequence
  Synthetic oligonucleotide
cagatattcaaagtaacaac

SEQ ID NO: 1399 - DNA, 20 bp, Artificial sequence
  Synthetic oligonucleotide
taatggtcaatacctgttta

SEQ ID NO: 1400 - DNA, 20 bp, Artificial sequence
  Synthetic oligonucleotide
aacattttcaattcagttaa

SEQ ID NO: 1401 - DNA, 20 bp, Artificial sequence
  Synthetic oligonucleotide
gcttgacccatagacatgca

SEQ ID NO: 1402 - DNA, 20 bp, Artificial sequence
  Synthetic oligonucleotide
cttcattattctctggagca

SEQ ID NO: 1403 - DNA, 20 bp, Artificial sequence
  Synthetic oligonucleotide
taagcacctcagcttctcaa

SEQ ID NO: 1404 - DNA, 20 bp, Artificial sequence
  Synthetic oligonucleotide
cagtcagtagctttcagtct

SEQ ID NO: 1405 - DNA, 20 bp, Artificial sequence
  Synthetic oligonucleotide
atcctgtttatgtttctact

SEQ ID NO: 1406 - DNA, 20 bp, Artificial sequence
  Synthetic oligonucleotide
ctgcaaatttttctaaaaat

SEQ ID NO: 1407 - DNA, 20 bp, Artificial sequence
  Synthetic oligonucleotide
tgaactcagaaaccccttac

SEQ ID NO: 1408 - DNA, 20 bp, Artificial sequence
  Synthetic oligonucleotide
aatacccagcttgttgagat

SEQ ID NO: 1409 - DNA, 20 bp, Artificial sequence
  Synthetic oligonucleotide
tcataggctccaaatcatca

SEQ ID NO: 1410 - DNA, 20 bp, Artificial sequence
  Synthetic oligonucleotide
atctcatttaccctgggcac

SEQ ID NO: 1411 - DNA, 20 bp, Artificial sequence
  Synthetic oligonucleotide
tgtacattcatcaaatcaaa

SEQ ID NO: 1412 - DNA, 20 bp, Artificial sequence
  Synthetic oligonucleotide
aacaaacagatcaaacatcc

SEQ ID NO: 1413 - DNA, 20 bp, Artificial sequence
  Synthetic oligonucleotide
caactctttctcctgctcca

SEQ ID NO: 1414 - DNA, 20 bp, Artificial sequence
  Synthetic oligonucleotide
ttgactgtaaaaatcatctt

SEQ ID NO: 1415 - DNA, 20 bp, Artificial sequence
  Synthetic oligonucleotide
tgagattcgcttgaacactt

SEQ ID NO: 1416 - DNA, 20 bp, Artificial sequence
  Synthetic oligonucleotide
ctgcccccagccaccaccgc

SEQ ID NO: 1417 - DNA, 20 bp, Artificial sequence
  Synthetic oligonucleotide
cccagccaccaccatgaggc

SEQ ID NO: 1418 - DNA, 20 bp, Artificial sequence
  Synthetic oligonucleotide
accacgcgctccatcatctt

SEQ ID NO: 1419 - DNA, 20 bp, Artificial sequence
  Synthetic oligonucleotide
ccagtgcccatcagtgccaa

SEQ ID NO: 1420 - DNA, 20 bp, Artificial sequence
  Synthetic oligonucleotide
cactaagtccaaaaataagt

SEQ ID NO: 1421 - DNA, 20 bp, Artificial sequence
  Synthetic oligonucleotide
gggttttcttaaaatggaaa

SEQ ID NO: 1422 - DNA, 20 bp, Artificial sequence
  Synthetic oligonucleotide
aaagtaaaacatcaccccag

SEQ ID NO: 1423 - DNA, 20 bp, Artificial sequence
  Synthetic oligonucleotide
agtgttgtgacaatatttac

SEQ ID NO: 1424 - DNA, 20 bp, Artificial sequence
  Synthetic oligonucleotide
tgttacagttatgttcactg

SEQ ID NO: 1425 - DNA, 20 bp, Artificial sequence
  Synthetic oligonucleotide
acatttgatttcaagtccca

SEQ ID NO: 1426 - DNA, 20 bp, Artificial sequence
  Synthetic oligonucleotide
gggtcctttaaacatctaaa

SEQ ID NO: 1427 - DNA, 20 bp, Artificial sequence
  Synthetic oligonucleotide
gaaggcaatttacttttcag

SEQ ID NO: 1428 - DNA, 20 bp, Artificial sequence
  Synthetic oligonucleotide
aaatcattctggtttccagg

SEQ ID NO: 1429 - DNA, 20 bp, Artificial sequence
  Synthetic oligonucleotide
atggtgctttcacaactgca

SEQ ID NO: 1430 - DNA, 20 bp, Artificial sequence
  Synthetic oligonucleotide
attttttaattacatcatcc

SEQ ID NO: 1431 - DNA, 20 bp, Artificial sequence
  Synthetic oligonucleotide
agcagttcttttctttgcac

SEQ ID NO: 1432 - DNA, 20 bp, Artificial sequence
  Synthetic oligonucleotide
tgaacttgacctaattctgg

SEQ ID NO: 1433 - DNA, 20 bp, Artificial sequence
  Synthetic oligonucleotide
ctccctattctttgattcaa

SEQ ID NO: 1434 - DNA, 20 bp, Artificial sequence
  Synthetic oligonucleotide
gtcatctccaacctaagata

SEQ ID NO: 1435 - DNA, 20 bp, Artificial sequence
  Synthetic oligonucleotide
cacttcaaatcaatcatatt

SEQ ID NO: 1436 - DNA, 20 bp, Artificial sequence
  Synthetic oligonucleotide
attttactttaattaacatt

SEQ ID NO: 1437 - DNA, 20 bp, Artificial sequence
  Synthetic oligonucleotide
tacatatctgctaggtgaca

SEQ ID NO: 1438 - DNA, 20 bp, Artificial sequence
  Synthetic oligonucleotide
tcctatgcaatatatatttt

SEQ ID NO: 1439 - DNA, 20 bp, Artificial sequence
  Synthetic oligonucleotide
tcagtaccttacaaaagtta

SEQ ID NO: 1440 - DNA, 20 bp, Artificial sequence
  Synthetic oligonucleotide
agtacatgcatatttcaaag

SEQ ID NO: 1441 - DNA, 20 bp, Artificial sequence
  Synthetic oligonucleotide
tttcagtcagatattaaaca

SEQ ID NO: 1442 - DNA, 20 bp, Artificial sequence
  Synthetic oligonucleotide
cgggaaacacttcaaatcat

SEQ ID NO: 1443 - DNA, 20 bp, Artificial sequence
  Synthetic oligonucleotide
tttgtaaaaatccttaatcc

SEQ ID NO: 1444 - DNA, 20 bp, Artificial sequence
  Synthetic oligonucleotide
tttaacatatttatccaatt

SEQ ID NO: 1445 - DNA, 20 bp, Artificial sequence
  Synthetic oligonucleotide
ggtgattttttcctttcttc

SEQ ID NO: 1446 - DNA, 20 bp, Artificial sequence
  Synthetic oligonucleotide
tagctttttttcactgtaag

SEQ ID NO: 1447 - DNA, 20 bp, Artificial sequence
  Synthetic oligonucleotide
aataacatacaaatcacatc

SEQ ID NO: 1448 - DNA, 20 bp, Artificial sequence
  Synthetic oligonucleotide
tttatctattataatcttaa

SEQ ID NO: 1449 - DNA, 20 bp, Artificial sequence
  Synthetic oligonucleotide
aatttgcattttattgtgta

SEQ ID NO: 1450 - DNA, 20 bp, Artificial sequence
  Synthetic oligonucleotide
gttgctgttactattaatta

SEQ ID NO: 1451 - DNA, 20 bp, Artificial sequence
  Synthetic oligonucleotide
gaaagtagctatcatttcct

SEQ ID NO: 1452 - DNA, 20 bp, Artificial sequence
  Synthetic oligonucleotide
ttcttaatgcatcaccagat

SEQ ID NO: 1453 - DNA, 20 bp, Artificial sequence
  Synthetic oligonucleotide
ttaggctcttttccaggtgt

SEQ ID NO: 1454 - DNA, 20 bp, Artificial sequence
  Synthetic oligonucleotide
tggttacataatgttcattt

SEQ ID NO: 1455 - DNA, 20 bp, Artificial sequence
  Synthetic oligonucleotide
ttacttgtcagtttttcccc

SEQ ID NO: 1456 - DNA, 20 bp, Artificial sequence
  Synthetic oligonucleotide
attttctgtgcttttccttt

SEQ ID NO: 1457 - DNA, 20 bp, Artificial sequence
  Synthetic oligonucleotide
taacaatctctcctttctct

SEQ ID NO: 1458 - DNA, 20 bp, Artificial sequence
  Synthetic oligonucleotide
gactttcaaccttcctaaga

SEQ ID NO: 1459 - DNA, 20 bp, Artificial sequence
  Synthetic oligonucleotide
ttaagctgattttacaagaa

SEQ ID NO: 1460 - DNA, 20 bp, Artificial sequence
  Synthetic oligonucleotide
tgttatttgattacattatt

SEQ ID NO: 1461 - DNA, 20 bp, Artificial sequence
  Synthetic oligonucleotide
aagttcagagaatctttcac

SEQ ID NO: 1462 - DNA, 20 bp, Artificial sequence
  Synthetic oligonucleotide
ggaatggttaacacatcgac

SEQ ID NO: 1463 - DNA, 20 bp, Artificial sequence
  Synthetic oligonucleotide
ctataaaagcttctcaggga

SEQ ID NO: 1464 - DNA, 20 bp, Artificial sequence
  Synthetic oligonucleotide
gtaagaacttatcccaaggt

SEQ ID NO: 1465 - DNA, 20 bp, Artificial sequence
  Synthetic oligonucleotide
taaatggcactttcttttta

SEQ ID NO: 1466 - DNA, 20 bp, Artificial sequence
  Synthetic oligonucleotide
ttgatagggattctatggaa

SEQ ID NO: 1467 - DNA, 20 bp, Artificial sequence
  Synthetic oligonucleotide
gtgtgatacatcacagtaac

SEQ ID NO: 1468 - DNA, 20 bp, Artificial sequence
  Synthetic oligonucleotide
aaatacaggacattccatcc

SEQ ID NO: 1469 - DNA, 20 bp, Artificial sequence
  Synthetic oligonucleotide
atctaggatttaacctgaaa

SEQ ID NO: 1470 - DNA, 20 bp, Artificial sequence
  Synthetic oligonucleotide
tctattgcttttatgctatt

SEQ ID NO: 1471 - DNA, 20 bp, Artificial sequence
  Synthetic oligonucleotide
ccaacttattttaacagttt

SEQ ID NO: 1472 - DNA, 20 bp, Artificial sequence
  Synthetic oligonucleotide
aggacagtaacatcatagaa

SEQ ID NO: 1473 - DNA, 20 bp, Artificial sequence
  Synthetic oligonucleotide
tgattagcttaacacacatt

SEQ ID NO: 1474 - DNA, 20 bp, Artificial sequence
  Synthetic oligonucleotide
tggattgtctttctattaag

SEQ ID NO: 1475 - DNA, 20 bp, Artificial sequence
  Synthetic oligonucleotide
acagatattcaaagtaacaa

SEQ ID NO: 1476 - DNA, 20 bp, Artificial sequence
  Synthetic oligonucleotide
gtaatggtcaatacctgttt

SEQ ID NO: 1477 - DNA, 20 bp, Artificial sequence
  Synthetic oligonucleotide
taacattttcaattcagtta

SEQ ID NO: 1478 - DNA, 20 bp, Artificial sequence
  Synthetic oligonucleotide
cacagcagtgttcctagaca

SEQ ID NO: 1479 - DNA, 20 bp, Artificial sequence
  Synthetic oligonucleotide
gcttcattattctctggagc

SEQ ID NO: 1480 - DNA, 20 bp, Artificial sequence
  Synthetic oligonucleotide
cagtagctctaccttgaaaa

SEQ ID NO: 1481 - DNA, 20 bp, Artificial sequence
  Synthetic oligonucleotide
caggaaatcaaactagggca

SEQ ID NO: 1482 - DNA, 20 bp, Artificial sequence
  Synthetic oligonucleotide
catcctgtttatgtttctac

SEQ ID NO: 1483 - DNA, 20 bp, Artificial sequence
  Synthetic oligonucleotide
gctgcaaatttttctaaaaa

SEQ ID NO: 1484 - DNA, 20 bp, Artificial sequence
  Synthetic oligonucleotide
gtgaactcagaaacccctta

SEQ ID NO: 1485 - DNA, 20 bp, Artificial sequence
  Synthetic oligonucleotide
tgatctgcaattgtttttct

SEQ ID NO: 1486 - DNA, 20 bp, Artificial sequence
  Synthetic oligonucleotide
atcataggctccaaatcatc

SEQ ID NO: 1487 - DNA, 20 bp, Artificial sequence
  Synthetic oligonucleotide
gatctcatttaccctgggca

SEQ ID NO: 1488 - DNA, 20 bp, Artificial sequence
  Synthetic oligonucleotide
atgtacattcatcaaatcaa

SEQ ID NO: 1489 - DNA, 20 bp, Artificial sequence
  Synthetic oligonucleotide
caacaaacagatcaaacatc

SEQ ID NO: 1490 - DNA, 20 bp, Artificial sequence
  Synthetic oligonucleotide
acacaactctttctcctgct

SEQ ID NO: 1491 - DNA, 20 bp, Artificial sequence
  Synthetic oligonucleotide
attgactgtaaaaatcatct

SEQ ID NO: 1492 - DNA, 20 bp, Artificial sequence
  Synthetic oligonucleotide
ttgagattcgcttgaacact

SEQ ID NO: 1493 - DNA, 20 bp, Artificial sequence
  Synthetic oligonucleotide
caccatgaggctgcccccag

SEQ ID NO: 1494 - DNA, 20 bp, Artificial sequence
  Synthetic oligonucleotide
ttgaccccagccaccaccat

SEQ ID NO: 1495 - DNA, 20 bp, Artificial sequence
  Synthetic oligonucleotide
atctgctcaaccacgcgctc

SEQ ID NO: 1496 - DNA, 20 bp, Artificial sequence
  Synthetic oligonucleotide
tccagtgcccatcagtgcca

SEQ ID NO: 1497 - DNA, 20 bp, Artificial sequence
  Synthetic oligonucleotide
gcactaagtccaaaaataag

SEQ ID NO: 1498 - DNA, 20 bp, Artificial sequence
  Synthetic oligonucleotide
cgggttttcttaaaatggaa

SEQ ID NO: 1499 - DNA, 20 bp, Artificial sequence
  Synthetic oligonucleotide
aaaagtaaaacatcacccca

SEQ ID NO: 1500 - DNA, 20 bp, Artificial sequence
  Synthetic oligonucleotide
tcagtgttgtgacaatattt

SEQ ID NO: 1501 - DNA, 20 bp, Artificial sequence
  Synthetic oligonucleotide
atgttacagttatgttcact

SEQ ID NO: 1502 - DNA, 20 bp, Artificial sequence
  Synthetic oligonucleotide
aacatttgatttcaagtccc

SEQ ID NO: 1503 - DNA, 20 bp, Artificial sequence
  Synthetic oligonucleotide
tagggtcctttaaacatcta

SEQ ID NO: 1504 - DNA, 20 bp, Artificial sequence
  Synthetic oligonucleotide
tagaaggcaatttacttttc

SEQ ID NO: 1505 - DNA, 20 bp, Artificial sequence
  Synthetic oligonucleotide
tcaaaatcattctggtttcc

SEQ ID NO: 1506 - DNA, 20 bp, Artificial sequence
  Synthetic oligonucleotide
gatggtgctttcacaactgc

SEQ ID NO: 1507 - DNA, 20 bp, Artificial sequence
  Synthetic oligonucleotide
cattttttaattacatcatc

SEQ ID NO: 1508 - DNA, 20 bp, Artificial sequence
  Synthetic oligonucleotide
aagcagttcttttctttgca

SEQ ID NO: 1509 - DNA, 20 bp, Artificial sequence
  Synthetic oligonucleotide
atgaacttgacctaattctg

SEQ ID NO: 1510 - DNA, 20 bp, Artificial sequence
  Synthetic oligonucleotide
tctccctattctttgattca

SEQ ID NO: 1511 - DNA, 20 bp, Artificial sequence
  Synthetic oligonucleotide
tgtcatctccaacctaagat

SEQ ID NO: 1512 - DNA, 20 bp, Artificial sequence
  Synthetic oligonucleotide
ccacttcaaatcaatcatat

SEQ ID NO: 1513 - DNA, 20 bp, Artificial sequence
  Synthetic oligonucleotide
ggaataattttactttaatt

SEQ ID NO: 1514 - DNA, 20 bp, Artificial sequence
  Synthetic oligonucleotide
aatacatatctgctaggtga

SEQ ID NO: 1515 - DNA, 20 bp, Artificial sequence
  Synthetic oligonucleotide
tgtcctatgcaatatatatt

SEQ ID NO: 1516 - DNA, 20 bp, Artificial sequence
  Synthetic oligonucleotide
ttcagtaccttacaaaagtt

SEQ ID NO: 1517 - DNA, 20 bp, Artificial sequence
  Synthetic oligonucleotide
taaagtacatgcatatttca

SEQ ID NO: 1518 - DNA, 20 bp, Artificial sequence
  Synthetic oligonucleotide
ggtggtgctcatcttcgctc

SEQ ID NO: 1519 - DNA, 20 bp, Artificial sequence
  Synthetic oligonucleotide
ggaaacgggaaacacttcaa

SEQ ID NO: 1520 - DNA, 20 bp, Artificial sequence
  Synthetic oligonucleotide
atatttgtaaaaatccttaa

SEQ ID NO: 1521 - DNA, 20 bp, Artificial sequence
  Synthetic oligonucleotide
gtttaacatatttatccaat

SEQ ID NO: 1522 - DNA, 20 bp, Artificial sequence
  Synthetic oligonucleotide
tggtgattttttcctttctt

SEQ ID NO: 1523 - DNA, 20 bp, Artificial sequence
  Synthetic oligonucleotide
ttagctttttttcactgtaa

SEQ ID NO: 1524 - DNA, 20 bp, Artificial sequence
  Synthetic oligonucleotide
atataaataacatacaaatc

SEQ ID NO: 1525 - DNA, 20 bp, Artificial sequence
  Synthetic oligonucleotide
atttatctattataatctta

SEQ ID NO: 1526 - DNA, 20 bp, Artificial sequence
  Synthetic oligonucleotide
ctaatttgcattttattgtg

SEQ ID NO: 1527 - DNA, 20 bp, Artificial sequence
  Synthetic oligonucleotide
aagttttgggcaaccttcca

SEQ ID NO: 1528 - DNA, 20 bp, Artificial sequence
  Synthetic oligonucleotide
agaaagtagctatcatttcc

SEQ ID NO: 1529 - DNA, 20 bp, Artificial sequence
  Synthetic oligonucleotide
gcttcttaatgcatcaccag

SEQ ID NO: 1530 - DNA, 20 bp, Artificial sequence
  Synthetic oligonucleotide
tttaggctcttttccaggtg

SEQ ID NO: 1531 - DNA, 20 bp, Artificial sequence
  Synthetic oligonucleotide
gtggttacataatgttcatt

SEQ ID NO: 1532 - DNA, 20 bp, Artificial sequence
  Synthetic oligonucleotide
cttttttacttgtcagtttt

SEQ ID NO: 1533 - DNA, 20 bp, Artificial sequence
  Synthetic oligonucleotide
ccgacaatttcaatgaaaac

SEQ ID NO: 1534 - DNA, 20 bp, Artificial sequence
  Synthetic oligonucleotide
atataacaatctctcctttc

SEQ ID NO: 1535 - DNA, 20 bp, Artificial sequence
  Synthetic oligonucleotide
tgactttcaaccttcctaag

SEQ ID NO: 1536 - DNA, 20 bp, Artificial sequence
  Synthetic oligonucleotide
gccatttctctgcaaaatta

SEQ ID NO: 1537 - DNA, 20 bp, Artificial sequence
  Synthetic oligonucleotide
ttgttatttgattacattat

SEQ ID NO: 1538 - DNA, 20 bp, Artificial sequence
  Synthetic oligonucleotide
aagtaagttaaaactgaagt

SEQ ID NO: 1539 - DNA, 20 bp, Artificial sequence
  Synthetic oligonucleotide
gatcacacaatactgtaaca

SEQ ID NO: 1540 - DNA, 20 bp, Artificial sequence
  Synthetic oligonucleotide
gagagtgcctagcgatggga

SEQ ID NO: 1541 - DNA, 20 bp, Artificial sequence
  Synthetic oligonucleotide
ctagtaagaacttatcccaa

SEQ ID NO: 1542 - DNA, 20 bp, Artificial sequence
  Synthetic oligonucleotide
gtaaatggcactttcttttt

SEQ ID NO: 1543 - DNA, 20 bp, Artificial sequence
  Synthetic oligonucleotide
ccttcacccaattttaggat

SEQ ID NO: 1544 - DNA, 20 bp, Artificial sequence
  Synthetic oligonucleotide
agtgtgatacatcacagtaa

SEQ ID NO: 1545 - DNA, 20 bp, Artificial sequence
  Synthetic oligonucleotide
caaacagacaaatacaggac

SEQ ID NO: 1546 - DNA, 20 bp, Artificial sequence
  Synthetic oligonucleotide
aacattcattcataatggca

SEQ ID NO: 1547 - DNA, 20 bp, Artificial sequence
  Synthetic oligonucleotide
aatctattgcttttatgcta

SEQ ID NO: 1548 - DNA, 20 bp, Artificial sequence
  Synthetic oligonucleotide
cccaacttattttaacagtt

SEQ ID NO: 1549 - DNA, 20 bp, Artificial sequence
  Synthetic oligonucleotide
gagaaatttctattttcctc

SEQ ID NO: 1550 - DNA, 20 bp, Artificial sequence
  Synthetic oligonucleotide
ttgattagcttaacacacat

SEQ ID NO: 1551 - DNA, 20 bp, Artificial sequence
  Synthetic oligonucleotide
atggattgtctttctattaa

SEQ ID NO: 1552 - DNA, 20 bp, Artificial sequence
  Synthetic oligonucleotide
acagtagcaataactgacca

SEQ ID NO: 1553 - DNA, 20 bp, Artificial sequence
  Synthetic oligonucleotide
tcctattaagtatatggtaa

SEQ ID NO: 1554 - DNA, 20 bp, Artificial sequence
  Synthetic oligonucleotide
ctaacattttcaattcagtt

SEQ ID NO: 1555 - DNA, 20 bp, Artificial sequence
  Synthetic oligonucleotide
gtttggttttgttcacagca

SEQ ID NO: 1556 - DNA, 20 bp, Artificial sequence
  Synthetic oligonucleotide
tggcttcattattctctgga

SEQ ID NO: 1557 - DNA, 20 bp, Artificial sequence
  Synthetic oligonucleotide
tcagtagctctaccttgaaa

SEQ ID NO: 1558 - DNA, 20 bp, Artificial sequence
  Synthetic oligonucleotide
gatgtagtccccacaatctc

SEQ ID NO: 1559 - DNA, 20 bp, Artificial sequence
  Synthetic oligonucleotide
acatcctgtttatgtttcta

SEQ ID NO: 1560 - DNA, 20 bp, Artificial sequence
  Synthetic oligonucleotide
agctgcaaatttttctaaaa

SEQ ID NO: 1561 - DNA, 20 bp, Artificial sequence
  Synthetic oligonucleotide
tgtgaactcagaaacccctt

SEQ ID NO: 1562 - DNA, 20 bp, Artificial sequence
  Synthetic oligonucleotide
gatgatctgcaattgttttt

SEQ ID NO: 1563 - DNA, 20 bp, Artificial sequence
  Synthetic oligonucleotide
taggtcaaatcataggctcc

SEQ ID NO: 1564 - DNA, 20 bp, Artificial sequence
  Synthetic oligonucleotide
agatctcatttaccctgggc

SEQ ID NO: 1565 - DNA, 20 bp, Artificial sequence
  Synthetic oligonucleotide
aatgtacattcatcaaatca

SEQ ID NO: 1566 - DNA, 20 bp, Artificial sequence
  Synthetic oligonucleotide
ccaaaacaacaaacagatca

SEQ ID NO: 1567 - DNA, 20 bp, Artificial sequence
  Synthetic oligonucleotide
aacacaactctttctcctgc

SEQ ID NO: 1568 - DNA, 20 bp, Artificial sequence
  Synthetic oligonucleotide
tcattgactgtaaaaatcat

SEQ ID NO: 1569 - DNA, 20 bp, Artificial sequence
  Synthetic oligonucleotide
agttgagattcgcttgaaca

SEQ ID NO: 1570 - DNA, 20 bp, Artificial sequence
  Synthetic oligonucleotide
ccaccatgaggctgccccca

SEQ ID NO: 1571 - DNA, 20 bp, Artificial sequence
  Synthetic oligonucleotide
ctccttgaccccagccacca

SEQ ID NO: 1572 - DNA, 20 bp, Artificial sequence
  Synthetic oligonucleotide
gatacacatctgctcaacca

SEQ ID NO: 1573 - DNA, 20 bp, Artificial sequence
  Synthetic oligonucleotide
ttccagtgcccatcagtgcc

SEQ ID NO: 1574 - DNA, 20 bp, Artificial sequence
  Synthetic oligonucleotide
ctgttgcactaagtccaaaa

SEQ ID NO: 1575 - DNA, 20 bp, Artificial sequence
  Synthetic oligonucleotide
tcgggttttcttaaaatgga

SEQ ID NO: 1576 - DNA, 20 bp, Artificial sequence
  Synthetic oligonucleotide
gaaaagtaaaacatcacccc

SEQ ID NO: 1577 - DNA, 20 bp, Artificial sequence
  Synthetic oligonucleotide
gttcagtgttgtgacaatat

SEQ ID NO: 1578 - DNA, 20 bp, Artificial sequence
  Synthetic oligonucleotide
tatgttacagttatgttcac

SEQ ID NO: 1579 - DNA, 20 bp, Artificial sequence
  Synthetic oligonucleotide
aaacatttgatttcaagtcc

SEQ ID NO: 1580 - DNA, 20 bp, Artificial sequence
  Synthetic oligonucleotide
tatagggtcctttaaacatc

SEQ ID NO: 1581 - DNA, 20 bp, Artificial sequence
  Synthetic oligonucleotide
ctagaaggcaatttactttt

SEQ ID NO: 1582 - DNA, 20 bp, Artificial sequence
  Synthetic oligonucleotide
gtcaaaatcattctggtttc

SEQ ID NO: 1583 - DNA, 20 bp, Artificial sequence
  Synthetic oligonucleotide
tgatggtgctttcacaactg

SEQ ID NO: 1584 - DNA, 20 bp, Artificial sequence
  Synthetic oligonucleotide
accattttttaattacatca

SEQ ID NO: 1585 - DNA, 20 bp, Artificial sequence
  Synthetic oligonucleotide
caagcagttcttttctttgc

SEQ ID NO: 1586 - DNA, 20 bp, Artificial sequence
  Synthetic oligonucleotide
ctatgaacttgacctaattc

SEQ ID NO: 1587 - DNA, 20 bp, Artificial sequence
  Synthetic oligonucleotide
gtctccctattctttgattc

SEQ ID NO: 1588 - DNA, 20 bp, Artificial sequence
  Synthetic oligonucleotide
ctgtcatctccaacctaaga

SEQ ID NO: 1589 - DNA, 20 bp, Artificial sequence
  Synthetic oligonucleotide
tccacttcaaatcaatcata

SEQ ID NO: 1590 - DNA, 20 bp, Artificial sequence
  Synthetic oligonucleotide
cagggaataattttacttta

SEQ ID NO: 1591 - DNA, 20 bp, Artificial sequence
  Synthetic oligonucleotide
gtaatacatatctgctaggt

SEQ ID NO: 1592 - DNA, 20 bp, Artificial sequence
  Synthetic oligonucleotide
tctgtcctatgcaatatata

SEQ ID NO: 1593 - DNA, 20 bp, Artificial sequence
  Synthetic oligonucleotide
attcagtaccttacaaaagt

SEQ ID NO: 1594 - DNA, 20 bp, Artificial sequence
  Synthetic oligonucleotide
caaagttacaaatatagaaa

SEQ ID NO: 1595 - DNA, 20 bp, Artificial sequence
  Synthetic oligonucleotide
cccgcggctcccctgccccc

SEQ ID NO: 1596 - DNA, 20 bp, Artificial sequence
  Synthetic oligonucleotide
ggagttttccctaaggaaac

SEQ ID NO: 1597 - DNA, 20 bp, Artificial sequence
  Synthetic oligonucleotide
tatatttgtaaaaatcctta

SEQ ID NO: 1598 - DNA, 20 bp, Artificial sequence
  Synthetic oligonucleotide
agtttaacatatttatccaa

SEQ ID NO: 1599 - DNA, 20 bp, Artificial sequence
  Synthetic oligonucleotide
ctggtgattttttcctttct

SEQ ID NO: 1600 - DNA, 20 bp, Artificial sequence
  Synthetic oligonucleotide
gttagctttttttcactgta

SEQ ID NO: 1601 - DNA, 20 bp, Artificial sequence
  Synthetic oligonucleotide
tagatataaataacatacaa

SEQ ID NO: 1602 - DNA, 20 bp, Artificial sequence
  Synthetic oligonucleotide
catttatctattataatctt

SEQ ID NO: 1603 - DNA, 20 bp, Artificial sequence
  Synthetic oligonucleotide
tctaatttgcattttattgt

SEQ ID NO: 1604 - DNA, 20 bp, Artificial sequence
  Synthetic oligonucleotide
ccaagttttgggcaaccttc

SEQ ID NO: 1605 - DNA, 20 bp, Artificial sequence
  Synthetic oligonucleotide
cagaaagtagctatcatttc

SEQ ID NO: 1606 - DNA, 20 bp, Artificial sequence
  Synthetic oligonucleotide
cagcttcttaatgcatcacc

SEQ ID NO: 1607 - DNA, 20 bp, Artificial sequence
  Synthetic oligonucleotide
atttaggctcttttccaggt

SEQ ID NO: 1608 - DNA, 20 bp, Artificial sequence
  Synthetic oligonucleotide
agtggttacataatgttcat

SEQ ID NO: 1609 - DNA, 20 bp, Artificial sequence
  Synthetic oligonucleotide
acttttttacttgtcagttt

SEQ ID NO: 1610 - DNA, 20 bp, Artificial sequence
  Synthetic oligonucleotide
accgacaatttcaatgaaaa

SEQ ID NO: 1611 - DNA, 20 bp, Artificial sequence
  Synthetic oligonucleotide
gcaaatataacaatctctcc

SEQ ID NO: 1612 - DNA, 20 bp, Artificial sequence
  Synthetic oligonucleotide
ggtgactttcaaccttccta

SEQ ID NO: 1613 - DNA, 20 bp, Artificial sequence
  Synthetic oligonucleotide
tgtggccatttctctgcaaa

SEQ ID NO: 1614 - DNA, 20 bp, Artificial sequence
  Synthetic oligonucleotide
tattgttatttgattacatt

SEQ ID NO: 1615 - DNA, 20 bp, Artificial sequence
  Synthetic oligonucleotide
ttttgaatgtttaatatgca

SEQ ID NO: 1616 - DNA, 20 bp, Artificial sequence
  Synthetic oligonucleotide
gtgatcacacaatactgtaa

SEQ ID NO: 1617 - DNA, 20 bp, Artificial sequence
  Synthetic oligonucleotide
acattgctggaacccatcac

SEQ ID NO: 1618 - DNA, 20 bp, Artificial sequence
  Synthetic oligonucleotide
gctagtaagaacttatccca

SEQ ID NO: 1619 - DNA, 20 bp, Artificial sequence
  Synthetic oligonucleotide
tgtaaatggcactttctttt

SEQ ID NO: 1620 - DNA, 20 bp, Artificial sequence
  Synthetic oligonucleotide
accttcacccaattttagga

SEQ ID NO: 1621 - DNA, 20 bp, Artificial sequence
  Synthetic oligonucleotide
aagtgtgatacatcacagta

SEQ ID NO: 1622 - DNA, 20 bp, Artificial sequence
  Synthetic oligonucleotide
ccaaacagacaaatacagga

SEQ ID NO: 1623 - DNA, 20 bp, Artificial sequence
  Synthetic oligonucleotide
gctgtagttaaacatttcat

SEQ ID NO: 1624 - DNA, 20 bp, Artificial sequence
  Synthetic oligonucleotide
tgaacaataatctattgctt

SEQ ID NO: 1625 - DNA, 20 bp, Artificial sequence
  Synthetic oligonucleotide
acccaacttattttaacagt

SEQ ID NO: 1626 - DNA, 20 bp, Artificial sequence
  Synthetic oligonucleotide
gagagaaatttctattttcc

SEQ ID NO: 1627 - DNA, 20 bp, Artificial sequence
  Synthetic oligonucleotide
attgattagcttaacacaca

SEQ ID NO: 1628 - DNA, 20 bp, Artificial sequence
  Synthetic oligonucleotide
atgcaactttccttaatgaa

SEQ ID NO: 1629 - DNA, 20 bp, Artificial sequence
  Synthetic oligonucleotide
ctacagtagcaataactgac

SEQ ID NO: 1630 - DNA, 20 bp, Artificial sequence
  Synthetic oligonucleotide
tcaagatatcctattaagta

SEQ ID NO: 1631 - DNA, 20 bp, Artificial sequence
  Synthetic oligonucleotide
gctaacattttcaattcagt

SEQ ID NO: 1632 - DNA, 20 bp, Artificial sequence
  Synthetic oligonucleotide
ggagtttggttttgttcaca

SEQ ID NO: 1633 - DNA, 20 bp, Artificial sequence
  Synthetic oligonucleotide
ccatcactctacctaaaaca

SEQ ID NO: 1634 - DNA, 20 bp, Artificial sequence
  Synthetic oligonucleotide
ctatcagcaaatctcagtag

SEQ ID NO: 1635 - DNA, 20 bp, Artificial sequence
  Synthetic oligonucleotide
ttggaggctcttttaggtgg

SEQ ID NO: 1636 - DNA, 20 bp, Artificial sequence
  Synthetic oligonucleotide
ttaacatcctgtttatgttt

SEQ ID NO: 1637 - DNA, 20 bp, Artificial sequence
  Synthetic oligonucleotide
tagctgcaaatttttctaaa

SEQ ID NO: 1638 - DNA, 20 bp, Artificial sequence
  Synthetic oligonucleotide
ttgtgaactcagaaacccct

SEQ ID NO: 1639 - DNA, 20 bp, Artificial sequence
  Synthetic oligonucleotide
gggatgatctgcaattgttt

SEQ ID NO: 1640 - DNA, 20 bp, Artificial sequence
  Synthetic oligonucleotide
ctaggtcaaatcataggctc

SEQ ID NO: 1641 - DNA, 20 bp, Artificial sequence
  Synthetic oligonucleotide
taaagatctcatttaccctg

SEQ ID NO: 1642 - DNA, 20 bp, Artificial sequence
  Synthetic oligonucleotide
gaatgtacattcatcaaatc

SEQ ID NO: 1643 - DNA, 20 bp, Artificial sequence
  Synthetic oligonucleotide
accaaaacaacaaacagatc

SEQ ID NO: 1644 - DNA, 20 bp, Artificial sequence
  Synthetic oligonucleotide
tgaacacaactctttctcct

SEQ ID NO: 1645 - DNA, 20 bp, Artificial sequence
  Synthetic oligonucleotide
ctcattgactgtaaaaatca

SEQ ID NO: 1646 - DNA, 20 bp, Artificial sequence
  Synthetic oligonucleotide
gagttgagattcgcttgaac

SEQ ID NO: 1647 - DNA, 20 bp, Artificial sequence
  Synthetic oligonucleotide
accaccatgaggctgccccc

SEQ ID NO: 1648 - DNA, 20 bp, Artificial sequence
  Synthetic oligonucleotide
ggtgccacctccttgacccc

SEQ ID NO: 1649 - DNA, 20 bp, Artificial sequence
  Synthetic oligonucleotide
tgggtgatacacatctgctc

SEQ ID NO: 1650 - DNA, 20 bp, Artificial sequence
  Synthetic oligonucleotide
tttccagtgcccatcagtgc

SEQ ID NO: 1651 - DNA, 20 bp, Artificial sequence
  Synthetic oligonucleotide
tagcctcaacctgttgcact

SEQ ID NO: 1652 - DNA, 20 bp, Artificial sequence
  Synthetic oligonucleotide
gcctcctaacaaacctggca

SEQ ID NO: 1653 - DNA, 20 bp, Artificial sequence
  Synthetic oligonucleotide
tgaaaagtaaaacatcaccc

SEQ ID NO: 1654 - DNA, 20 bp, Artificial sequence
  Synthetic oligonucleotide
ggttcagtgttgtgacaata

SEQ ID NO: 1655 - DNA, 20 bp, Artificial sequence
  Synthetic oligonucleotide
atatgttacagttatgttca

SEQ ID NO: 1656 - DNA, 20 bp, Artificial sequence
  Synthetic oligonucleotide
caaacatttgatttcaagtc

SEQ ID NO: 1657 - DNA, 20 bp, Artificial sequence
  Synthetic oligonucleotide
atatagggtcctttaaacat

SEQ ID NO: 1658 - DNA, 20 bp, Artificial sequence
  Synthetic oligonucleotide
tctagaaggcaatttacttt

SEQ ID NO: 1659 - DNA, 20 bp, Artificial sequence
  Synthetic oligonucleotide
tgtcaaaatcattctggttt

SEQ ID NO: 1660 - DNA, 20 bp, Artificial sequence
  Synthetic oligonucleotide
atgatggtgctttcacaact

SEQ ID NO: 1661 - DNA, 20 bp, Artificial sequence
  Synthetic oligonucleotide
gaccattttttaattacatc

SEQ ID NO: 1662 - DNA, 20 bp, Artificial sequence
  Synthetic oligonucleotide
gcaagcagttcttttctttg

SEQ ID NO: 1663 - DNA, 20 bp, Artificial sequence
  Synthetic oligonucleotide
gaaactatgaacttgaccta

SEQ ID NO: 1664 - DNA, 20 bp, Artificial sequence
  Synthetic oligonucleotide
tgtctccctattctttgatt

SEQ ID NO: 1665 - DNA, 20 bp, Artificial sequence
  Synthetic oligonucleotide
tctgtcatctccaacctaag

SEQ ID NO: 1666 - DNA, 20 bp, Artificial sequence
  Synthetic oligonucleotide
ttccacttcaaatcaatcat

SEQ ID NO: 1667 - DNA, 20 bp, Artificial sequence
  Synthetic oligonucleotide
tcagggaataattttacttt

SEQ ID NO: 1668 - DNA, 20 bp, Artificial sequence
  Synthetic oligonucleotide
agtaatacatatctgctagg

SEQ ID NO: 1669 - DNA, 20 bp, Artificial sequence
  Synthetic oligonucleotide
gtctgtcctatgcaatatat

SEQ ID NO: 1670 - DNA, 20 bp, Artificial sequence
  Synthetic oligonucleotide
tattcagtaccttacaaaag

SEQ ID NO: 1671 - DNA, 20 bp, Artificial sequence
  Synthetic oligonucleotide
gcaaagttacaaatatagaa

SEQ ID NO: 1672 - DNA, 20 bp, Artificial sequence
  Synthetic oligonucleotide
aggagttttccctaaggaaa

SEQ ID NO: 1673 - DNA, 20 bp, Artificial sequence
  Synthetic oligonucleotide
ttatatttgtaaaaatcctt

SEQ ID NO: 1674 - DNA, 20 bp, Artificial sequence
  Synthetic oligonucleotide
aagtttaacatatttatcca

SEQ ID NO: 1675 - DNA, 20 bp, Artificial sequence
  Synthetic oligonucleotide
actggtgattttttcctttc

SEQ ID NO: 1676 - DNA, 20 bp, Artificial sequence
  Synthetic oligonucleotide
ggttagctttttttcactgt

SEQ ID NO: 1677 - DNA, 20 bp, Artificial sequence
  Synthetic oligonucleotide
ttagatataaataacataca

SEQ ID NO: 1678 - DNA, 20 bp, Artificial sequence
  Synthetic oligonucleotide
ccatttatctattataatct

SEQ ID NO: 1679 - DNA, 20 bp, Artificial sequence
  Synthetic oligonucleotide
gctctaatttgcattttatt

SEQ ID NO: 1680 - DNA, 20 bp, Artificial sequence
  Synthetic oligonucleotide
cagacacttgaaaatgccaa

SEQ ID NO: 1681 - DNA, 20 bp, Artificial sequence
  Synthetic oligonucleotide
gcagaaagtagctatcattt

SEQ ID NO: 1682 - DNA, 20 bp, Artificial sequence
  Synthetic oligonucleotide
ccagcttcttaatgcatcac

SEQ ID NO: 1683 - DNA, 20 bp, Artificial sequence
  Synthetic oligonucleotide
gtgttatacatttaggctct

SEQ ID NO: 1684 - DNA, 20 bp, Artificial sequence
  Synthetic oligonucleotide
ttagtggttacataatgttc

SEQ ID NO: 1685 - DNA, 20 bp, Artificial sequence
  Synthetic oligonucleotide
cccacttttttacttgtcag

SEQ ID NO: 1686 - DNA, 20 bp, Artificial sequence
  Synthetic oligonucleotide
tcaccgacaatttcaatgaa

SEQ ID NO: 1687 - DNA, 20 bp, Artificial sequence
  Synthetic oligonucleotide
agcaaatataacaatctctc

SEQ ID NO: 1688 - DNA, 20 bp, Artificial sequence
  Synthetic oligonucleotide
tggtgactttcaaccttcct

SEQ ID NO: 1689 - DNA, 20 bp, Artificial sequence
  Synthetic oligonucleotide
tctgtggccatttctctgca

SEQ ID NO: 1690 - DNA, 20 bp, Artificial sequence
  Synthetic oligonucleotide
gttattattgttatttgatt

SEQ ID NO: 1691 - DNA, 20 bp, Artificial sequence
  Synthetic oligonucleotide
catgttttgaatgtttaata

SEQ ID NO: 1692 - DNA, 20 bp, Artificial sequence
  Synthetic oligonucleotide
ccttaaagtgatcacacaat

SEQ ID NO: 1693 - DNA, 20 bp, Artificial sequence
  Synthetic oligonucleotide
ctgaaaaaaattttgcacaa

SEQ ID NO: 1694 - DNA, 20 bp, Artificial sequence
  Synthetic oligonucleotide
gttcatcttattcccattta

SEQ ID NO: 1695 - DNA, 20 bp, Artificial sequence
  Synthetic oligonucleotide
gctaaatttattctgaaata

SEQ ID NO: 1696 - DNA, 20 bp, Artificial sequence
  Synthetic oligonucleotide
aagatgccaccttcacccaa

SEQ ID NO: 1697 - DNA, 20 bp, Artificial sequence
  Synthetic oligonucleotide
tgatacagtgggattcatcc

SEQ ID NO: 1698 - DNA, 20 bp, Artificial sequence
  Synthetic oligonucleotide
acttagaccaaatggatcca

SEQ ID NO: 1699 - DNA, 20 bp, Artificial sequence
  Synthetic oligonucleotide
agtttttcaaatcaacaaat

SEQ ID NO: 1700 - DNA, 20 bp, Artificial sequence
  Synthetic oligonucleotide
cccaagatatcataatttta

SEQ ID NO: 1701 - DNA, 20 bp, Artificial sequence
  Synthetic oligonucleotide
agcacccaacttattttaac

SEQ ID NO: 1702 - DNA, 20 bp, Artificial sequence
  Synthetic oligonucleotide
ggagatcaaatctgtggagc

SEQ ID NO: 1703 - DNA, 20 bp, Artificial sequence
  Synthetic oligonucleotide
gcacaataatttattgatta

SEQ ID NO: 1704 - DNA, 20 bp, Artificial sequence
  Synthetic oligonucleotide
gtaaagattcttgttcagca

SEQ ID NO: 1705 - DNA, 20 bp, Artificial sequence
  Synthetic oligonucleotide
aacggcattcctctacagta

SEQ ID NO: 1706 - DNA, 20 bp, Artificial sequence
  Synthetic oligonucleotide
ttcaagatatcctattaagt

SEQ ID NO: 1707 - DNA, 20 bp, Artificial sequence
  Synthetic oligonucleotide
cagctaacattttcaattca

SEQ ID NO: 1708 - DNA, 20 bp, Artificial sequence
  Synthetic oligonucleotide
agtgcaggctcctttagggc

SEQ ID NO: 1709 - DNA, 20 bp, Artificial sequence
  Synthetic oligonucleotide
aaggcttttcttccagctac

SEQ ID NO: 1710 - DNA, 20 bp, Artificial sequence
  Synthetic oligonucleotide
tctatcagcaaatctcagta

SEQ ID NO: 1711 - DNA, 20 bp, Artificial sequence
  Synthetic oligonucleotide
tttggaggctcttttaggtg

SEQ ID NO: 1712 - DNA, 20 bp, Artificial sequence
  Synthetic oligonucleotide
aataaattaacatcctgttt

SEQ ID NO: 1713 - DNA, 20 bp, Artificial sequence
  Synthetic oligonucleotide
ttagctgcaaatttttctaa

SEQ ID NO: 1714 - DNA, 20 bp, Artificial sequence
  Synthetic oligonucleotide
tagaacatttttgtgaactc

SEQ ID NO: 1715 - DNA, 20 bp, Artificial sequence
  Synthetic oligonucleotide
tgggatgatctgcaattgtt

SEQ ID NO: 1716 - DNA, 20 bp, Artificial sequence
  Synthetic oligonucleotide
cctaggtcaaatcataggct

SEQ ID NO: 1717 - DNA, 20 bp, Artificial sequence
  Synthetic oligonucleotide
ttaaagatctcatttaccct

SEQ ID NO: 1718 - DNA, 20 bp, Artificial sequence
  Synthetic oligonucleotide
agaatgtacattcatcaaat

SEQ ID NO: 1719 - DNA, 20 bp, Artificial sequence
  Synthetic oligonucleotide
taccaaaacaacaaacagat

SEQ ID NO: 1720 - DNA, 20 bp, Artificial sequence
  Synthetic oligonucleotide
gtgaacacaactctttctcc

SEQ ID NO: 1721 - DNA, 20 bp, Artificial sequence
  Synthetic oligonucleotide
gctcattgactgtaaaaatc

SEQ ID NO: 1722 - DNA, 20 bp, Artificial sequence
  Synthetic oligonucleotide
aaacgagttgagattcgctt

SEQ ID NO: 1723 - DNA, 20 bp, Artificial sequence
  Synthetic oligonucleotide
caccaccatgaggctgcccc

SEQ ID NO: 1724 - DNA, 20 bp, Artificial sequence
  Synthetic oligonucleotide
tgggtgccacctccttgacc

SEQ ID NO: 1725 - DNA, 20 bp, Artificial sequence
  Synthetic oligonucleotide
accttcctcatcccactatc

SEQ ID NO: 1726 - DNA, 20 bp, Artificial sequence
  Synthetic oligonucleotide
tctatgttttccagtgccca

SEQ ID NO: 1727 - DNA, 20 bp, Artificial sequence
  Synthetic oligonucleotide
ttttagcctcaacctgttgc

SEQ ID NO: 1728 - DNA, 20 bp, Artificial sequence
  Synthetic oligonucleotide
atgtggcctcctaacaaacc

SEQ ID NO: 1729 - DNA, 20 bp, Artificial sequence
  Synthetic oligonucleotide
gtgaaaagtaaaacatcacc

SEQ ID NO: 1730 - DNA, 20 bp, Artificial sequence
  Synthetic oligonucleotide
aggttcagtgttgtgacaat

SEQ ID NO: 1731 - DNA, 20 bp, Artificial sequence
  Synthetic oligonucleotide
tatatgttacagttatgttc

SEQ ID NO: 1732 - DNA, 20 bp, Artificial sequence
  Synthetic oligonucleotide
ccaaacatttgatttcaagt

SEQ ID NO: 1733 - DNA, 20 bp, Artificial sequence
  Synthetic oligonucleotide
aggaatgccacatatagggt

SEQ ID NO: 1734 - DNA, 20 bp, Artificial sequence
  Synthetic oligonucleotide
gtctagaaggcaatttactt

SEQ ID NO: 1735 - DNA, 20 bp, Artificial sequence
  Synthetic oligonucleotide
atgtcaaaatcattctggtt

SEQ ID NO: 1736 - DNA, 20 bp, Artificial sequence
  Synthetic oligonucleotide
gatgatggtgctttcacaac

SEQ ID NO: 1737 - DNA, 20 bp, Artificial sequence
  Synthetic oligonucleotide
tgaccattttttaattacat

SEQ ID NO: 1738 - DNA, 20 bp, Artificial sequence
  Synthetic oligonucleotide
tgcaagcagttcttttcttt

SEQ ID NO: 1739 - DNA, 20 bp, Artificial sequence
  Synthetic oligonucleotide
agaaactatgaacttgacct

SEQ ID NO: 1740 - DNA, 20 bp, Artificial sequence
  Synthetic oligonucleotide
ttgtctccctattctttgat

SEQ ID NO: 1741 - DNA, 20 bp, Artificial sequence
  Synthetic oligonucleotide
ttctgtcatctccaacctaa

SEQ ID NO: 1742 - DNA, 20 bp, Artificial sequence
  Synthetic oligonucleotide
tttccacttcaaatcaatca

SEQ ID NO: 1743 - DNA, 20 bp, Artificial sequence
  Synthetic oligonucleotide
ttcagggaataattttactt

SEQ ID NO: 1744 - DNA, 20 bp, Artificial sequence
  Synthetic oligonucleotide
aagtaatacatatctgctag

SEQ ID NO: 1745 - DNA, 20 bp, Artificial sequence
  Synthetic oligonucleotide
taaacaaaactcctaagtct

SEQ ID NO: 1746 - DNA, 20 bp, Artificial sequence
  Synthetic oligonucleotide
gtattcagtaccttacaaaa

SEQ ID NO: 1747 - DNA, 20 bp, Artificial sequence
  Synthetic oligonucleotide
tgcaaagttacaaatataga

SEQ ID NO: 1748 - DNA, 20 bp, Artificial sequence
  Synthetic oligonucleotide
agatcctcatcattacagca

SEQ ID NO: 1749 - DNA, 20 bp, Artificial sequence
  Synthetic oligonucleotide
caggagttttccctaaggaa

SEQ ID NO: 1750 - DNA, 20 bp, Artificial sequence
  Synthetic oligonucleotide
tgataattatatttgtaaaa

SEQ ID NO: 1751 - DNA, 20 bp, Artificial sequence
  Synthetic oligonucleotide
gaagtttaacatatttatcc

SEQ ID NO: 1752 - DNA, 20 bp, Artificial sequence
  Synthetic oligonucleotide
ccactggtgattttttcctt

SEQ ID NO: 1753 - DNA, 20 bp, Artificial sequence
  Synthetic oligonucleotide
tggttagctttttttcactg

SEQ ID NO: 1754 - DNA, 20 bp, Artificial sequence
  Synthetic oligonucleotide
gttagatataaataacatac

SEQ ID NO: 1755 - DNA, 20 bp, Artificial sequence
  Synthetic oligonucleotide
gccatttatctattataatc

SEQ ID NO: 1756 - DNA, 20 bp, Artificial sequence
  Synthetic oligonucleotide
atgctctaatttgcatttta

SEQ ID NO: 1757 - DNA, 20 bp, Artificial sequence
  Synthetic oligonucleotide
ccagacacttgaaaatgcca

SEQ ID NO: 1758 - DNA, 20 bp, Artificial sequence
  Synthetic oligonucleotide
cgcagaaagtagctatcatt

SEQ ID NO: 1759 - DNA, 20 bp, Artificial sequence
  Synthetic oligonucleotide
cttccagcttcttaatgcat

SEQ ID NO: 1760 - DNA, 20 bp, Artificial sequence
  Synthetic oligonucleotide
tggtgttatacatttaggct

SEQ ID NO: 1761 - DNA, 20 bp, Artificial sequence
  Synthetic oligonucleotide
catgatttttagtggttaca

SEQ ID NO: 1762 - DNA, 20 bp, Artificial sequence
  Synthetic oligonucleotide
aacccacttttttacttgtc

SEQ ID NO: 1763 - DNA, 20 bp, Artificial sequence
  Synthetic oligonucleotide
atcaccgacaatttcaatga

SEQ ID NO: 1764 - DNA, 20 bp, Artificial sequence
  Synthetic oligonucleotide
tagcaaatataacaatctct

SEQ ID NO: 1765 - DNA, 20 bp, Artificial sequence
  Synthetic oligonucleotide
ttggtgactttcaaccttcc

SEQ ID NO: 1766 - DNA, 20 bp, Artificial sequence
  Synthetic oligonucleotide
aaatctgtggccatttctct

SEQ ID NO: 1767 - DNA, 20 bp, Artificial sequence
  Synthetic oligonucleotide
ctgttatgttattattgtta

SEQ ID NO: 1768 - DNA, 20 bp, Artificial sequence
  Synthetic oligonucleotide
acatgttttgaatgtttaat

SEQ ID NO: 1769 - DNA, 20 bp, Artificial sequence
  Synthetic oligonucleotide
ctcccttaaagtgatcacac

SEQ ID NO: 1770 - DNA, 20 bp, Artificial sequence
  Synthetic oligonucleotide
gctgaaaaaaattttgcaca

SEQ ID NO: 1771 - DNA, 20 bp, Artificial sequence
  Synthetic oligonucleotide
cgttcatcttattcccattt

SEQ ID NO: 1772 - DNA, 20 bp, Artificial sequence
  Synthetic oligonucleotide
tggctaaatttattctgaaa

SEQ ID NO: 1773 - DNA, 20 bp, Artificial sequence
  Synthetic oligonucleotide
aaagatgccaccttcaccca

SEQ ID NO: 1774 - DNA, 20 bp, Artificial sequence
  Synthetic oligonucleotide
agatcatttactatgataca

SEQ ID NO: 1775 - DNA, 20 bp, Artificial sequence
  Synthetic oligonucleotide
cttacacttcacttagacca

SEQ ID NO: 1776 - DNA, 20 bp, Artificial sequence
  Synthetic oligonucleotide
gtagtttttcaaatcaacaa

SEQ ID NO: 1777 - DNA, 20 bp, Artificial sequence
  Synthetic oligonucleotide
gcccaagatatcataatttt

SEQ ID NO: 1778 - DNA, 20 bp, Artificial sequence
  Synthetic oligonucleotide
cagcacccaacttattttaa

SEQ ID NO: 1779 - DNA, 20 bp, Artificial sequence
  Synthetic oligonucleotide
aaggagatcaaatctgtgga

SEQ ID NO: 1780 - DNA, 20 bp, Artificial sequence
  Synthetic oligonucleotide
ggcacaataatttattgatt

SEQ ID NO: 1781 - DNA, 20 bp, Artificial sequence
  Synthetic oligonucleotide
tgcagaggaacaacacatac

SEQ ID NO: 1782 - DNA, 20 bp, Artificial sequence
  Synthetic oligonucleotide
gataacatgagaaccaacgc

SEQ ID NO: 1783 - DNA, 20 bp, Artificial sequence
  Synthetic oligonucleotide
tttcaagatatcctattaag

SEQ ID NO: 1784 - DNA, 20 bp, Artificial sequence
  Synthetic oligonucleotide
ccagctaacattttcaattc

SEQ ID NO: 1785 - DNA, 20 bp, Artificial sequence
  Synthetic oligonucleotide
ttattattcatgttctccac

SEQ ID NO: 1786 - DNA, 20 bp, Artificial sequence
  Synthetic oligonucleotide
tagaaggcttttcttccagc

SEQ ID NO: 1787 - DNA, 20 bp, Artificial sequence
  Synthetic oligonucleotide
acattggatctatcagcaaa

SEQ ID NO: 1788 - DNA, 20 bp, Artificial sequence
  Synthetic oligonucleotide
agttaaagtactcaggtcat

SEQ ID NO: 1789 - DNA, 20 bp, Artificial sequence
  Synthetic oligonucleotide
aaataaattaacatcctgtt

SEQ ID NO: 1790 - DNA, 20 bp, Artificial sequence
  Synthetic oligonucleotide
aattagctgcaaatttttct

SEQ ID NO: 1791 - DNA, 20 bp, Artificial sequence
  Synthetic oligonucleotide
tttagaacatttttgtgaac

SEQ ID NO: 1792 - DNA, 20 bp, Artificial sequence
  Synthetic oligonucleotide
gaagttagtcttgtcctcag

SEQ ID NO: 1793 - DNA, 20 bp, Artificial sequence
  Synthetic oligonucleotide
ccctaggtcaaatcataggc

SEQ ID NO: 1794 - DNA, 20 bp, Artificial sequence
  Synthetic oligonucleotide
attaaagatctcatttaccc

SEQ ID NO: 1795 - DNA, 20 bp, Artificial sequence
  Synthetic oligonucleotide
gagaatgtacattcatcaaa

SEQ ID NO: 1796 - DNA, 20 bp, Artificial sequence
  Synthetic oligonucleotide
tgtaccaaaacaacaaacag

SEQ ID NO: 1797 - DNA, 20 bp, Artificial sequence
  Synthetic oligonucleotide
acactgttgccaccctgtac

SEQ ID NO: 1798 - DNA, 20 bp, Artificial sequence
  Synthetic oligonucleotide
ggctcattgactgtaaaaat

SEQ ID NO: 1799 - DNA, 20 bp, Artificial sequence
  Synthetic oligonucleotide
aaaacgagttgagattcgct

SEQ ID NO: 1800 - DNA, 20 bp, Artificial sequence
  Synthetic oligonucleotide
ccaccaccatgaggctgccc

SEQ ID NO: 1801 - DNA, 20 bp, Artificial sequence
  Synthetic oligonucleotide
actgtgggtgccacctcctt

SEQ ID NO: 1802 - DNA, 20 bp, Artificial sequence
  Synthetic oligonucleotide
agaccttcctcatcccacta

SEQ ID NO: 1803 - DNA, 20 bp, Artificial sequence
  Synthetic oligonucleotide
tctactctatgttttccagt

SEQ ID NO: 1804 - DNA, 20 bp, Artificial sequence
  Synthetic oligonucleotide
ttgttttagcctcaacctgt

SEQ ID NO: 1805 - DNA, 20 bp, Artificial sequence
  Synthetic oligonucleotide
catgtggcctcctaacaaac

SEQ ID NO: 1806 - DNA, 20 bp, Artificial sequence
  Synthetic oligonucleotide
tgtgaaaagtaaaacatcac

SEQ ID NO: 1807 - DNA, 20 bp, Artificial sequence
  Synthetic oligonucleotide
gaggttcagtgttgtgacaa

SEQ ID NO: 1808 - DNA, 20 bp, Artificial sequence
  Synthetic oligonucleotide
atatatgttacagttatgtt

SEQ ID NO: 1809 - DNA, 20 bp, Artificial sequence
  Synthetic oligonucleotide
tcccaaacatttgatttcaa

SEQ ID NO: 1810 - DNA, 20 bp, Artificial sequence
  Synthetic oligonucleotide
tagtttaaagaaaggaatgc

SEQ ID NO: 1811 - DNA, 20 bp, Artificial sequence
  Synthetic oligonucleotide
tgtctagaaggcaatttact

SEQ ID NO: 1812 - DNA, 20 bp, Artificial sequence
  Synthetic oligonucleotide
tatgtcaaaatcattctggt

SEQ ID NO: 1813 - DNA, 20 bp, Artificial sequence
  Synthetic oligonucleotide
tgatgatggtgctttcacaa

SEQ ID NO: 1814 - DNA, 20 bp, Artificial sequence
  Synthetic oligonucleotide
ctgaccattttttaattaca

SEQ ID NO: 1815 - DNA, 20 bp, Artificial sequence
  Synthetic oligonucleotide
atgcaagcagttcttttctt

SEQ ID NO: 1816 - DNA, 20 bp, Artificial sequence
  Synthetic oligonucleotide
cagaaactatgaacttgacc

SEQ ID NO: 1817 - DNA, 20 bp, Artificial sequence
  Synthetic oligonucleotide
attgtctccctattctttga

SEQ ID NO: 1818 - DNA, 20 bp, Artificial sequence
  Synthetic oligonucleotide
tttctgtcatctccaaccta

SEQ ID NO: 1819 - DNA, 20 bp, Artificial sequence
  Synthetic oligonucleotide
ttttccacttcaaatcaatc

SEQ ID NO: 1820 - DNA, 20 bp, Artificial sequence
  Synthetic oligonucleotide
attcagggaataattttact

SEQ ID NO: 1821 - DNA, 20 bp, Artificial sequence
  Synthetic oligonucleotide
aaaagtaatacatatctgct

SEQ ID NO: 1822 - DNA, 20 bp, Artificial sequence
  Synthetic oligonucleotide
gctctaaacaaaactcctaa

SEQ ID NO: 1823 - DNA, 20 bp, Artificial sequence
  Synthetic oligonucleotide
agtattcagtaccttacaaa

SEQ ID NO: 1824 - DNA, 20 bp, Artificial sequence
  Synthetic oligonucleotide
acatgcaaagttacaaatat

SEQ ID NO: 1825 - DNA, 20 bp, Artificial sequence
  Synthetic oligonucleotide
tgaagatcctcatcattaca

SEQ ID NO: 1826 - DNA, 20 bp, Artificial sequence
  Synthetic oligonucleotide
ccaggagttttccctaagga

SEQ ID NO: 1827 - DNA, 20 bp, Artificial sequence
  Synthetic oligonucleotide
ttgataattatatttgtaaa

SEQ ID NO: 1828 - DNA, 20 bp, Artificial sequence
  Synthetic oligonucleotide
agaagtttaacatatttatc

SEQ ID NO: 1829 - DNA, 20 bp, Artificial sequence
  Synthetic oligonucleotide
tccactggtgattttttcct

SEQ ID NO: 1830 - DNA, 20 bp, Artificial sequence
  Synthetic oligonucleotide
ctggttagctttttttcact

SEQ ID NO: 1831 - DNA, 20 bp, Artificial sequence
  Synthetic oligonucleotide
tgttagatataaataacata

SEQ ID NO: 1832 - DNA, 20 bp, Artificial sequence
  Synthetic oligonucleotide
tgccatttatctattataat

SEQ ID NO: 1833 - DNA, 20 bp, Artificial sequence
  Synthetic oligonucleotide
aacatgctctaatttgcatt

SEQ ID NO: 1834 - DNA, 20 bp, Artificial sequence
  Synthetic oligonucleotide
cagaaccatctttgtgaccc

SEQ ID NO: 1835 - DNA, 20 bp, Artificial sequence
  Synthetic oligonucleotide
aactcatacatacagacgca

SEQ ID NO: 1836 - DNA, 20 bp, Artificial sequence
  Synthetic oligonucleotide
gcttccagcttcttaatgca

SEQ ID NO: 1837 - DNA, 20 bp, Artificial sequence
  Synthetic oligonucleotide
taattttcttagctactgcc

SEQ ID NO: 1838 - DNA, 20 bp, Artificial sequence
  Synthetic oligonucleotide
atcatgatttttagtggtta

SEQ ID NO: 1839 - DNA, 20 bp, Artificial sequence
  Synthetic oligonucleotide
taacccacttttttacttgt

SEQ ID NO: 1840 - DNA, 20 bp, Artificial sequence
  Synthetic oligonucleotide
agatcaccgacaatttcaat

SEQ ID NO: 1841 - DNA, 20 bp, Artificial sequence
  Synthetic oligonucleotide
gtagcaaatataacaatctc

SEQ ID NO: 1842 - DNA, 20 bp, Artificial sequence
  Synthetic oligonucleotide
catttggtgactttcaacct

SEQ ID NO: 1843 - DNA, 20 bp, Artificial sequence
  Synthetic oligonucleotide
attctaaaaatctgtggcca

SEQ ID NO: 1844 - DNA, 20 bp, Artificial sequence
  Synthetic oligonucleotide
tctgttatgttattattgtt

SEQ ID NO: 1845 - DNA, 20 bp, Artificial sequence
  Synthetic oligonucleotide
agatacagacatgttttgaa

SEQ ID NO: 1846 - DNA, 20 bp, Artificial sequence
  Synthetic oligonucleotide
gattacctcccttaaagtga

SEQ ID NO: 1847 - DNA, 20 bp, Artificial sequence
  Synthetic oligonucleotide
gttatattttaattttctga

SEQ ID NO: 1848 - DNA, 20 bp, Artificial sequence
  Synthetic oligonucleotide
ccgttcatcttattcccatt

SEQ ID NO: 1849 - DNA, 20 bp, Artificial sequence
  Synthetic oligonucleotide
tcttggctaaatttattctg

SEQ ID NO: 1850 - DNA, 20 bp, Artificial sequence
  Synthetic oligonucleotide
caaagatgccaccttcaccc

SEQ ID NO: 1851 - DNA, 20 bp, Artificial sequence
  Synthetic oligonucleotide
aaagatcatttactatgata

SEQ ID NO: 1852 - DNA, 20 bp, Artificial sequence
  Synthetic oligonucleotide
acttacacttcacttagacc

SEQ ID NO: 1853 - DNA, 20 bp, Artificial sequence
  Synthetic oligonucleotide
tggtagtttttcaaatcaac

SEQ ID NO: 1854 - DNA, 20 bp, Artificial sequence
  Synthetic oligonucleotide
cacaaagcccaagatatcat

SEQ ID NO: 1855 - DNA, 20 bp, Artificial sequence
  Synthetic oligonucleotide
cacacttagccaccctgcca

SEQ ID NO: 1856 - DNA, 20 bp, Artificial sequence
  Synthetic oligonucleotide
tagcttggtgggcttaagga

SEQ ID NO: 1857 - DNA, 20 bp, Artificial sequence
  Synthetic oligonucleotide
tggcacaataatttattgat

SEQ ID NO: 1858 - DNA, 20 bp, Artificial sequence
  Synthetic oligonucleotide
ccaattctacatgttctcat

SEQ ID NO: 1859 - DNA, 20 bp, Artificial sequence
  Synthetic oligonucleotide
gcacatagaaaatccaacag

SEQ ID NO: 1860 - DNA, 20 bp, Artificial sequence
  Synthetic oligonucleotide
ggcatatttcaagatatcct

SEQ ID NO: 1861 - DNA, 20 bp, Artificial sequence
  Synthetic oligonucleotide
gccagctaacattttcaatt

SEQ ID NO: 1862 - DNA, 20 bp, Artificial sequence
  Synthetic oligonucleotide
cttattattcatgttctcca

SEQ ID NO: 1863 - DNA, 20 bp, Artificial sequence
  Synthetic oligonucleotide
cctagaaggcttttcttcca

SEQ ID NO: 1864 - DNA, 20 bp, Artificial sequence
  Synthetic oligonucleotide
tacattggatctatcagcaa

SEQ ID NO: 1865 - DNA, 20 bp, Artificial sequence
  Synthetic oligonucleotide
agagttaaagtactcaggtc

SEQ ID NO: 1866 - DNA, 20 bp, Artificial sequence
  Synthetic oligonucleotide
aataaataaattaacatcct

SEQ ID NO: 1867 - DNA, 20 bp, Artificial sequence
  Synthetic oligonucleotide
tttatcacccaattagctgc

SEQ ID NO: 1868 - DNA, 20 bp, Artificial sequence
  Synthetic oligonucleotide
ctgttgccaattttagaaca

SEQ ID NO: 1869 - DNA, 20 bp, Artificial sequence
  Synthetic oligonucleotide
ctggaacactgaagttagtc

SEQ ID NO: 1870 - DNA, 20 bp, Artificial sequence
  Synthetic oligonucleotide
ctgctgtaccctaggtcaaa

SEQ ID NO: 1871 - DNA, 20 bp, Artificial sequence
  Synthetic oligonucleotide
tttcaaattaaagatctcat

SEQ ID NO: 1872 - DNA, 20 bp, Artificial sequence
  Synthetic oligonucleotide
ggagaatgtacattcatcaa

SEQ ID NO: 1873 - DNA, 20 bp, Artificial sequence
  Synthetic oligonucleotide
ttgtaccaaaacaacaaaca

SEQ ID NO: 1874 - DNA, 20 bp, Artificial sequence
  Synthetic oligonucleotide
tgctcagtagaaacactgtt

SEQ ID NO: 1875 - DNA, 20 bp, Artificial sequence
  Synthetic oligonucleotide
tggctcattgactgtaaaaa

SEQ ID NO: 1876 - DNA, 20 bp, Artificial sequence
  Synthetic oligonucleotide
aaaaaacgagttgagattcg

SEQ ID NO: 1877 - DNA, 20 bp, Artificial sequence
  Synthetic oligonucleotide
gccaccaccatgaggctgcc

SEQ ID NO: 1878 - DNA, 20 bp, Artificial sequence
  Synthetic oligonucleotide
cttactcggcttgttccact

SEQ ID NO: 1879 - DNA, 20 bp, Artificial sequence
  Synthetic oligonucleotide
aagaccttcctcatcccact

SEQ ID NO: 1880 - DNA, 20 bp, Artificial sequence
  Synthetic oligonucleotide
caggtctactctatgttttc

SEQ ID NO: 1881 - DNA, 20 bp, Artificial sequence
  Synthetic oligonucleotide
gagatttgttttagcctcaa

SEQ ID NO: 1882 - DNA, 20 bp, Artificial sequence
  Synthetic oligonucleotide
tcatgtggcctcctaacaaa

SEQ ID NO: 1883 - DNA, 20 bp, Artificial sequence
  Synthetic oligonucleotide
ctgtgaaaagtaaaacatca

SEQ ID NO: 1884 - DNA, 20 bp, Artificial sequence
  Synthetic oligonucleotide
ccagaggttcagtgttgtga

SEQ ID NO: 1885 - DNA, 20 bp, Artificial sequence
  Synthetic oligonucleotide
ttcatatatgttacagttat

SEQ ID NO: 1886 - DNA, 20 bp, Artificial sequence
  Synthetic oligonucleotide
cattcccaaacatttgattt

SEQ ID NO: 1887 - DNA, 20 bp, Artificial sequence
  Synthetic oligonucleotide
cctatagtttaaagaaagga

SEQ ID NO: 1888 - DNA, 20 bp, Artificial sequence
  Synthetic oligonucleotide
gtgtctagaaggcaatttac

SEQ ID NO: 1889 - DNA, 20 bp, Artificial sequence
  Synthetic oligonucleotide
gtatgtcaaaatcattctgg

SEQ ID NO: 1890 - DNA, 20 bp, Artificial sequence
  Synthetic oligonucleotide
atgatgatggtgctttcaca

SEQ ID NO: 1891 - DNA, 20 bp, Artificial sequence
  Synthetic oligonucleotide
actgaccattttttaattac

SEQ ID NO: 1892 - DNA, 20 bp, Artificial sequence
  Synthetic oligonucleotide
agaaatgcaagcagttcttt

SEQ ID NO: 1893 - DNA, 20 bp, Artificial sequence
  Synthetic oligonucleotide
tacagaaactatgaacttga

SEQ ID NO: 1894 - DNA, 20 bp, Artificial sequence
  Synthetic oligonucleotide
gattgtctccctattctttg

SEQ ID NO: 1895 - DNA, 20 bp, Artificial sequence
  Synthetic oligonucleotide
atttctgtcatctccaacct

SEQ ID NO: 1896 - DNA, 20 bp, Artificial sequence
  Synthetic oligonucleotide
ctttttccacttcaaatcaa

SEQ ID NO: 1897 - DNA, 20 bp, Artificial sequence
  Synthetic oligonucleotide
aattcagggaataattttac

SEQ ID NO: 1898 - DNA, 20 bp, Artificial sequence
  Synthetic oligonucleotide
gaaaagtaatacatatctgc

SEQ ID NO: 1899 - DNA, 20 bp, Artificial sequence
  Synthetic oligonucleotide
ctgctctaaacaaaactcct

SEQ ID NO: 1900 - DNA, 20 bp, Artificial sequence
  Synthetic oligonucleotide
aagtattcagtaccttacaa

SEQ ID NO: 1901 - DNA, 20 bp, Artificial sequence
  Synthetic oligonucleotide
aagaacatgcaaagttacaa

SEQ ID NO: 1902 - DNA, 20 bp, Artificial sequence
  Synthetic oligonucleotide
atgaagatcctcatcattac

SEQ ID NO: 1903 - DNA, 20 bp, Artificial sequence
  Synthetic oligonucleotide
taccaggagttttccctaag

SEQ ID NO: 1904 - DNA, 20 bp, Artificial sequence
  Synthetic oligonucleotide
tttgataattatatttgtaa

SEQ ID NO: 1905 - DNA, 20 bp, Artificial sequence
  Synthetic oligonucleotide
cagaagtttaacatatttat

SEQ ID NO: 1906 - DNA, 20 bp, Artificial sequence
  Synthetic oligonucleotide
attgctcctttccactggtg

SEQ ID NO: 1907 - DNA, 20 bp, Artificial sequence
  Synthetic oligonucleotide
actggttagctttttttcac

SEQ ID NO: 1908 - DNA, 20 bp, Artificial sequence
  Synthetic oligonucleotide
gtgttagatataaataacat

SEQ ID NO: 1909 - DNA, 20 bp, Artificial sequence
  Synthetic oligonucleotide
ttgccatttatctattataa

SEQ ID NO: 1910 - DNA, 20 bp, Artificial sequence
  Synthetic oligonucleotide
aaacatgctctaatttgcat

SEQ ID NO: 1911 - DNA, 20 bp, Artificial sequence
  Synthetic oligonucleotide
gcagaaccatctttgtgacc

SEQ ID NO: 1912 - DNA, 20 bp, Artificial sequence
  Synthetic oligonucleotide
aataactcatacatacagac

SEQ ID NO: 1913 - DNA, 20 bp, Artificial sequence
  Synthetic oligonucleotide
tgggtcacagcttccagctt

SEQ ID NO: 1914 - DNA, 20 bp, Artificial sequence
  Synthetic oligonucleotide
gtcataattttcttagctac

SEQ ID NO: 1915 - DNA, 20 bp, Artificial sequence
  Synthetic oligonucleotide
aaatcatgatttttagtggt

SEQ ID NO: 1916 - DNA, 20 bp, Artificial sequence
  Synthetic oligonucleotide
aataacccacttttttactt

SEQ ID NO: 1917 - DNA, 20 bp, Artificial sequence
  Synthetic oligonucleotide
gaaaattaagatcaccgaca

SEQ ID NO: 1918 - DNA, 20 bp, Artificial sequence
  Synthetic oligonucleotide
tcttttattctaagtagcaa

SEQ ID NO: 1919 - DNA, 20 bp, Artificial sequence
  Synthetic oligonucleotide
accctcattttctgtgacat

SEQ ID NO: 1920 - DNA, 20 bp, Artificial sequence
  Synthetic oligonucleotide
aattctaaaaatctgtggcc

SEQ ID NO: 1921 - DNA, 20 bp, Artificial sequence
  Synthetic oligonucleotide
aaacttctgttatgttatta

SEQ ID NO: 1922 - DNA, 20 bp, Artificial sequence
  Synthetic oligonucleotide
tagatacagacatgttttga

SEQ ID NO: 1923 - DNA, 20 bp, Artificial sequence
  Synthetic oligonucleotide
ggattacctcccttaaagtg

SEQ ID NO: 1924 - DNA, 20 bp, Artificial sequence
  Synthetic oligonucleotide
cttgttatattttaattttc

SEQ ID NO: 1925 - DNA, 20 bp, Artificial sequence
  Synthetic oligonucleotide
gaagaaaatttttaatgaga

SEQ ID NO: 1926 - DNA, 20 bp, Artificial sequence
  Synthetic oligonucleotide
tatctttctatttgtgtctc

SEQ ID NO: 1927 - DNA, 20 bp, Artificial sequence
  Synthetic oligonucleotide
acaaagatgccaccttcacc

SEQ ID NO: 1928 - DNA, 20 bp, Artificial sequence
  Synthetic oligonucleotide
gcaaattcaacagctcatta

SEQ ID NO: 1929 - DNA, 20 bp, Artificial sequence
  Synthetic oligonucleotide
atcagacttacacttcactt

SEQ ID NO: 1930 - DNA, 20 bp, Artificial sequence
  Synthetic oligonucleotide
gtggtagtttttcaaatcaa

SEQ ID NO: 1931 - DNA, 20 bp, Artificial sequence
  Synthetic oligonucleotide
ctgtcacaaacacaaagccc

SEQ ID NO: 1932 - DNA, 20 bp, Artificial sequence
  Synthetic oligonucleotide
gcacacttagccaccctgcc

SEQ ID NO: 1933 - DNA, 20 bp, Artificial sequence
  Synthetic oligonucleotide
cagttttgaataagatactt

SEQ ID NO: 1934 - DNA, 20 bp, Artificial sequence
  Synthetic oligonucleotide
attattgtgccaccaagcct

SEQ ID NO: 1935 - DNA, 20 bp, Artificial sequence
  Synthetic oligonucleotide
cagaaaacccaattctacat

SEQ ID NO: 1936 - DNA, 20 bp, Artificial sequence
  Synthetic oligonucleotide
tgcacatagaaaatccaaca

SEQ ID NO: 1937 - DNA, 20 bp, Artificial sequence
  Synthetic oligonucleotide
tggcatatttcaagatatcc

SEQ ID NO: 1938 - DNA, 20 bp, Artificial sequence
  Synthetic oligonucleotide
agtatttttgacaatggcca

SEQ ID NO: 1939 - DNA, 20 bp, Artificial sequence
  Synthetic oligonucleotide
gcttattattcatgttctcc

SEQ ID NO: 1940 - DNA, 20 bp, Artificial sequence
  Synthetic oligonucleotide
tgacaagcccatcctgtctc

SEQ ID NO: 1941 - DNA, 20 bp, Artificial sequence
  Synthetic oligonucleotide
attttctctcccagcataca

SEQ ID NO: 1942 - DNA, 20 bp, Artificial sequence
  Synthetic oligonucleotide
acaagcagagttaaagtact

SEQ ID NO: 1943 - DNA, 20 bp, Artificial sequence
  Synthetic oligonucleotide
ctggataatattcataaaaa

SEQ ID NO: 1944 - DNA, 20 bp, Artificial sequence
  Synthetic oligonucleotide
ctttatcacccaattagctg

SEQ ID NO: 1945 - DNA, 20 bp, Artificial sequence
  Synthetic oligonucleotide
aactgttgccaattttagaa

SEQ ID NO: 1946 - DNA, 20 bp, Artificial sequence
  Synthetic oligonucleotide
atatactggaacactgaagt

SEQ ID NO: 1947 - DNA, 20 bp, Artificial sequence
  Synthetic oligonucleotide
tacctgctgtaccctaggtc

SEQ ID NO: 1948 - DNA, 20 bp, Artificial sequence
  Synthetic oligonucleotide
tcttttcaaattaaagatct

SEQ ID NO: 1949 - DNA, 20 bp, Artificial sequence
  Synthetic oligonucleotide
tggagaatgtacattcatca

SEQ ID NO: 1950 - DNA, 20 bp, Artificial sequence
  Synthetic oligonucleotide
ctaatttttgtaccaaaaca

SEQ ID NO: 1951 - DNA, 20 bp, Artificial sequence
  Synthetic oligonucleotide
agtgcatagcaatggtatca

SEQ ID NO: 1952 - DNA, 20 bp, Artificial sequence
  Synthetic oligonucleotide
catctttaattggaaattcg

SEQ ID NO: 1953 - DNA, 20 bp, Artificial sequence
  Synthetic oligonucleotide
atcagttgataccgcctgcg

SEQ ID NO: 1954 - DNA, 20 bp, Artificial sequence
  Synthetic oligonucleotide
catgtggccacaaagagaac

SEQ ID NO: 1955 - DNA, 20 bp, Artificial sequence
  Synthetic oligonucleotide
aggctgcccccagccaccac

SEQ ID NO: 1956 - DNA, 20 bp, Artificial sequence
  Synthetic oligonucleotide
cgccaaggccccccaccact

SEQ ID NO: 1957 - DNA, 20 bp, Artificial sequence
  Synthetic oligonucleotide
acaggaagaccttcctcatc

SEQ ID NO: 1958 - DNA, 20 bp, Artificial sequence
  Synthetic oligonucleotide
ctcatgatgaactcaatcaa

SEQ ID NO: 1959 - DNA, 20 bp, Artificial sequence
  Synthetic oligonucleotide
ctatgaaatctctactaaga

SEQ ID NO: 1960 - DNA, 20 bp, Artificial sequence
  Synthetic oligonucleotide
gaataagtatcatgtggcct

SEQ ID NO: 1961 - DNA, 20 bp, Artificial sequence
  Synthetic oligonucleotide
atatttactcttgttgaaca

SEQ ID NO: 1962 - DNA, 20 bp, Artificial sequence
  Synthetic oligonucleotide
tcactgtgaatatgtcctct

SEQ ID NO: 1963 - DNA, 20 bp, Artificial sequence
  Synthetic oligonucleotide
aagcctttcatatatgttac

SEQ ID NO: 1964 - DNA, 20 bp, Artificial sequence
  Synthetic oligonucleotide
aagggcaccattcccaaaca

SEQ ID NO: 1965 - DNA, 20 bp, Artificial sequence
  Synthetic oligonucleotide
cagctgccttaattacctat

SEQ ID NO: 1966 - DNA, 20 bp, Artificial sequence
  Synthetic oligonucleotide
ggagatttgccttcagtgtc

SEQ ID NO: 1967 - DNA, 20 bp, Artificial sequence
  Synthetic oligonucleotide
agctctcctgtatgtcaaaa

SEQ ID NO: 1968 - DNA, 20 bp, Artificial sequence
  Synthetic oligonucleotide
atcatcctctatgatgatgg

SEQ ID NO: 1969 - DNA, 20 bp, Artificial sequence
  Synthetic oligonucleotide
tctttgcacactgaccattt

SEQ ID NO: 1970 - DNA, 20 bp, Artificial sequence
  Synthetic oligonucleotide
tttttgacaattatgagaca

SEQ ID NO: 1971 - DNA, 20 bp, Artificial sequence
  Synthetic oligonucleotide
tcaaaagccaattacagaaa

SEQ ID NO: 1972 - DNA, 20 bp, Artificial sequence
  Synthetic oligonucleotide
attttttagattgtctccct

SEQ ID NO: 1973 - DNA, 20 bp, Artificial sequence
  Synthetic oligonucleotide
atcatatttctgtcatctcc

SEQ ID NO: 1974 - DNA, 20 bp, Artificial sequence
  Synthetic oligonucleotide
aacagaatttctttttccac

SEQ ID NO: 1975 - DNA, 20 bp, Artificial sequence
  Synthetic oligonucleotide
gacaatatcaaacaattcag

SEQ ID NO: 1976 - DNA, 20 bp, Artificial sequence
  Synthetic oligonucleotide
tgcaagccaataataacatt

SEQ ID NO: 1977 - DNA, 20 bp, Artificial sequence
  Synthetic oligonucleotide
ttcagatgttaactgctcta

SEQ ID NO: 1978 - DNA, 20 bp, Artificial sequence
  Synthetic oligonucleotide
aaagggtttcccacatatta

SEQ ID NO: 1979 - DNA, 20 bp, Artificial sequence
  Synthetic oligonucleotide
ttatataacaaaacaagaac

SEQ ID NO: 1980 - DNA, 20 bp, Artificial sequence
  Synthetic oligonucleotide
atgctctcagaacaagaaaa

SEQ ID NO: 1981 - DNA, 20 bp, Artificial sequence
  Synthetic oligonucleotide
ttaatcctattctaccagga

SEQ ID NO: 1982 - DNA, 20 bp, Artificial sequence
  Synthetic oligonucleotide
ccaattccctgttcctatgt

SEQ ID NO: 1983 - DNA, 20 bp, Artificial sequence
  Synthetic oligonucleotide
ttgatttttccagaagttta

SEQ ID NO: 1984 - DNA, 20 bp, Artificial sequence
  Synthetic oligonucleotide
aagtaaaattgctcctttcc

SEQ ID NO: 1985 - DNA, 20 bp, Artificial sequence
  Synthetic oligonucleotide
cacatcctacccctctgcct

SEQ ID NO: 1986 - DNA, 20 bp, Artificial sequence
  Synthetic oligonucleotide
ttaatattttcctttcggtg

SEQ ID NO: 1987 - DNA, 20 bp, Artificial sequence
  Synthetic oligonucleotide
atcattttgccatttatcta

SEQ ID NO: 1988 - DNA, 20 bp, Artificial sequence
  Synthetic oligonucleotide
tgtaaaatgataacccaaac

SEQ ID NO: 1989 - DNA, 20 bp, Artificial sequence
  Synthetic oligonucleotide
gtccaaggtcacaaaattga

SEQ ID NO: 1990 - DNA, 20 bp, Artificial sequence
  Synthetic oligonucleotide
cgaaatgcccccaataactc

SEQ ID NO: 1991 - DNA, 20 bp, Artificial sequence
  Synthetic oligonucleotide
tagatcattctgctaggaat

SEQ ID NO: 1992 - DNA, 20 bp, Artificial sequence
  Synthetic oligonucleotide
taatgtgtcataattttctt

SEQ ID NO: 1993 - DNA, 20 bp, Artificial sequence
  Synthetic oligonucleotide
ccacatatcacaggctccaa

SEQ ID NO: 1994 - DNA, 20 bp, Artificial sequence
  Synthetic oligonucleotide
tgcagttaataacccacttt

SEQ ID NO: 1995 - DNA, 20 bp, Artificial sequence
  Synthetic oligonucleotide
gagagcaatatattcaccaa

SEQ ID NO: 1996 - DNA, 20 bp, Artificial sequence
  Synthetic oligonucleotide
actaaatcattaatcaacta

SEQ ID NO: 1997 - DNA, 20 bp, Artificial sequence
  Synthetic oligonucleotide
tgatcacagcctttcctgac

SEQ ID NO: 1998 - DNA, 20 bp, Artificial sequence
  Synthetic oligonucleotide
tcagcataattctaaaaatc

SEQ ID NO: 1999 - DNA, 20 bp, Artificial sequence
  Synthetic oligonucleotide
tggtgcagaaacttctgtta

SEQ ID NO: 2000 - DNA, 20 bp, Artificial sequence
  Synthetic oligonucleotide
attttataatgctgtagcca

SEQ ID NO: 2001 - DNA, 20 bp, Artificial sequence
  Synthetic oligonucleotide
actgaaggattacctccctt

SEQ ID NO: 2002 - DNA, 20 bp, Artificial sequence
  Synthetic oligonucleotide
cataatgtcccttgtctctt

SEQ ID NO: 2003 - DNA, 20 bp, Artificial sequence
  Synthetic oligonucleotide
tctaattttgtacacaatac

SEQ ID NO: 2004 - DNA, 20 bp, Artificial sequence
  Synthetic oligonucleotide
agcacaggctatctttctat

SEQ ID NO: 2005 - DNA, 20 bp, Artificial sequence
  Synthetic oligonucleotide
attgagagcttttcctctta

SEQ ID NO: 2006 - DNA, 20 bp, Artificial sequence
  Synthetic oligonucleotide
acaaaattctagcgaagcaa

SEQ ID NO: 2007 - DNA, 20 bp, Artificial sequence
  Synthetic oligonucleotide
gctttggatctcttagattt

SEQ ID NO: 2008 - DNA, 20 bp, Artificial sequence
  Synthetic oligonucleotide
tataatttttttacctggaa

SEQ ID NO: 2009 - DNA, 20 bp, Artificial sequence
  Synthetic oligonucleotide
atgaaaatcaatatcattcc

SEQ ID NO: 2010 - DNA, 20 bp, Artificial sequence
  Synthetic oligonucleotide
tagacatgtaaactttgcca

SEQ ID NO: 2011 - DNA, 20 bp, Artificial sequence
  Synthetic oligonucleotide
agtgtcagaattctaagggt

SEQ ID NO: 2012 - DNA, 20 bp, Artificial sequence
  Synthetic oligonucleotide
taggtgacccacaacacatt

SEQ ID NO: 2013 - DNA, 20 bp, Artificial sequence
  Synthetic oligonucleotide
agtgtggtacatatatgcta

SEQ ID NO: 2014 - DNA, 20 bp, Artificial sequence
  Synthetic oligonucleotide
ctatttgcaattagtgtgat

SEQ ID NO: 2015 - DNA, 20 bp, Artificial sequence
  Synthetic oligonucleotide
ctaagatactctctgtcacc

SEQ ID NO: 2016 - DNA, 20 bp, Artificial sequence
  Synthetic oligonucleotide
tactaaatatttataatgga

SEQ ID NO: 2017 - DNA, 20 bp, Artificial sequence
  Synthetic oligonucleotide
tctgtgcttattattcatgt

SEQ ID NO: 2018 - DNA, 20 bp, Artificial sequence
  Synthetic oligonucleotide
ccatcacttctcacctgatt

SEQ ID NO: 2019 - DNA, 20 bp, Artificial sequence
  Synthetic oligonucleotide
agtgactgaattttctctcc

SEQ ID NO: 2020 - DNA, 20 bp, Artificial sequence
  Synthetic oligonucleotide
gtggtcataagcaaatcaaa

SEQ ID NO: 2021 - DNA, 20 bp, Artificial sequence
  Synthetic oligonucleotide
ttttcatctccttcagagct

SEQ ID NO: 2022 - DNA, 20 bp, Artificial sequence
  Synthetic oligonucleotide
cccttacctttatcacccaa

SEQ ID NO: 2023 - DNA, 20 bp, Artificial sequence
  Synthetic oligonucleotide
ccatgtacagttcaatggtt

SEQ ID NO: 2024 - DNA, 20 bp, Artificial sequence
  Synthetic oligonucleotide
gccgtaaaacctataatggc

SEQ ID NO: 2025 - DNA, 20 bp, Artificial sequence
  Synthetic oligonucleotide
aatgattgctaaacagtacc

SEQ ID NO: 2026 - DNA, 20 bp, Artificial sequence
  Synthetic oligonucleotide
aatcaaaaatctcttttcaa

SEQ ID NO: 2027 - DNA, 20 bp, Artificial sequence
  Synthetic oligonucleotide
ccagaatgacaatttatgac

SEQ ID NO: 2028 - DNA, 20 bp, Artificial sequence
  Synthetic oligonucleotide
gtgaattattttcttctaat

SEQ ID NO: 2029 - DNA, 20 bp, Artificial sequence
  Synthetic oligonucleotide
tcatctttaattggaaattc

SEQ ID NO: 2030 - DNA, 20 bp, Artificial sequence
  Synthetic oligonucleotide
ttgcatcagttgataccgcc

SEQ ID NO: 2031 - DNA, 20 bp, Artificial sequence
  Synthetic oligonucleotide
ccatgtggccacaaagagaa

SEQ ID NO: 2032 - DNA, 20 bp, Artificial sequence
  Synthetic oligonucleotide
gaggctgcccccagccacca

SEQ ID NO: 2033 - DNA, 20 bp, Artificial sequence
  Synthetic oligonucleotide
taacggtcctcatagtcact

SEQ ID NO: 2034 - DNA, 20 bp, Artificial sequence
  Synthetic oligonucleotide
aaacaggaagaccttcctca

SEQ ID NO: 2035 - DNA, 20 bp, Artificial sequence
  Synthetic oligonucleotide
cattagcaacggctcatgat

SEQ ID NO: 2036 - DNA, 20 bp, Artificial sequence
  Synthetic oligonucleotide
gctatgaaatctctactaag

SEQ ID NO: 2037 - DNA, 20 bp, Artificial sequence
  Synthetic oligonucleotide
ggatttttttgaataagtat

SEQ ID NO: 2038 - DNA, 20 bp, Artificial sequence
  Synthetic oligonucleotide
aatatttactcttgttgaac

SEQ ID NO: 2039 - DNA, 20 bp, Artificial sequence
  Synthetic oligonucleotide
ttcactgtgaatatgtcctc

SEQ ID NO: 2040 - DNA, 20 bp, Artificial sequence
  Synthetic oligonucleotide
agaagcctttcatatatgtt

SEQ ID NO: 2041 - DNA, 20 bp, Artificial sequence
  Synthetic oligonucleotide
caagggcaccattcccaaac

SEQ ID NO: 2042 - DNA, 20 bp, Artificial sequence
  Synthetic oligonucleotide
tcagctgccttaattaccta

SEQ ID NO: 2043 - DNA, 20 bp, Artificial sequence
  Synthetic oligonucleotide
aggagatttgccttcagtgt

SEQ ID NO: 2044 - DNA, 20 bp, Artificial sequence
  Synthetic oligonucleotide
gcagctctcctgtatgtcaa

SEQ ID NO: 2045 - DNA, 20 bp, Artificial sequence
  Synthetic oligonucleotide
catcatcctctatgatgatg

SEQ ID NO: 2046 - DNA, 20 bp, Artificial sequence
  Synthetic oligonucleotide
ttctttgcacactgaccatt

SEQ ID NO: 2047 - DNA, 20 bp, Artificial sequence
  Synthetic oligonucleotide
gtttttgacaattatgagac

SEQ ID NO: 2048 - DNA, 20 bp, Artificial sequence
  Synthetic oligonucleotide
ttcaaaagccaattacagaa

SEQ ID NO: 2049 - DNA, 20 bp, Artificial sequence
  Synthetic oligonucleotide
tattttttagattgtctccc

SEQ ID NO: 2050 - DNA, 20 bp, Artificial sequence
  Synthetic oligonucleotide
aatcatatttctgtcatctc

SEQ ID NO: 2051 - DNA, 20 bp, Artificial sequence
  Synthetic oligonucleotide
taacagaatttctttttcca

SEQ ID NO: 2052 - DNA, 20 bp, Artificial sequence
  Synthetic oligonucleotide
tgacaatatcaaacaattca

SEQ ID NO: 2053 - DNA, 20 bp, Artificial sequence
  Synthetic oligonucleotide
agtgcaagccaataataaca

SEQ ID NO: 2054 - DNA, 20 bp, Artificial sequence
  Synthetic oligonucleotide
acttcagatgttaactgctc

SEQ ID NO: 2055 - DNA, 20 bp, Artificial sequence
  Synthetic oligonucleotide
attgtaagcctaaggaccac

SEQ ID NO: 2056 - DNA, 20 bp, Artificial sequence
  Synthetic oligonucleotide
tttatataacaaaacaagaa

SEQ ID NO: 2057 - DNA, 20 bp, Artificial sequence
  Synthetic oligonucleotide
gatgctctcagaacaagaaa

SEQ ID NO: 2058 - DNA, 20 bp, Artificial sequence
  Synthetic oligonucleotide
ccttaatcctattctaccag

SEQ ID NO: 2059 - DNA, 20 bp, Artificial sequence
  Synthetic oligonucleotide
tatccaattccctgttccta

SEQ ID NO: 2060 - DNA, 20 bp, Artificial sequence
  Synthetic oligonucleotide
gttgatttttccagaagttt

SEQ ID NO: 2061 - DNA, 20 bp, Artificial sequence
  Synthetic oligonucleotide
taagtaaaattgctcctttc

SEQ ID NO: 2062 - DNA, 20 bp, Artificial sequence
  Synthetic oligonucleotide
atcacatcctacccctctgc

SEQ ID NO: 2063 - DNA, 20 bp, Artificial sequence
  Synthetic oligonucleotide
cttaatattttcctttcggt

SEQ ID NO: 2064 - DNA, 20 bp, Artificial sequence
  Synthetic oligonucleotide
catcattttgccatttatct

SEQ ID NO: 2065 - DNA, 20 bp, Artificial sequence
  Synthetic oligonucleotide
tagatgtaaaatgataaccc

SEQ ID NO: 2066 - DNA, 20 bp, Artificial sequence
  Synthetic oligonucleotide
gatcaggaaattaggtagcc

SEQ ID NO: 2067 - DNA, 20 bp, Artificial sequence
  Synthetic oligonucleotide
tcgaaatgcccccaataact

SEQ ID NO: 2068 - DNA, 20 bp, Artificial sequence
  Synthetic oligonucleotide
aattttagatcattctgcta

SEQ ID NO: 2069 - DNA, 20 bp, Artificial sequence
  Synthetic oligonucleotide
ttcagttaatgtgtcataat

SEQ ID NO: 2070 - DNA, 20 bp, Artificial sequence
  Synthetic oligonucleotide
cccacatatcacaggctcca

SEQ ID NO: 2071 - DNA, 20 bp, Artificial sequence
  Synthetic oligonucleotide
caggtgcagttaataaccca

SEQ ID NO: 2072 - DNA, 20 bp, Artificial sequence
  Synthetic oligonucleotide
tgagagcaatatattcacca

SEQ ID NO: 2073 - DNA, 20 bp, Artificial sequence
  Synthetic oligonucleotide
tactaaatcattaatcaact

SEQ ID NO: 2074 - DNA, 20 bp, Artificial sequence
  Synthetic oligonucleotide
gtgatcacagcctttcctga

SEQ ID NO: 2075 - DNA, 20 bp, Artificial sequence
  Synthetic oligonucleotide
ttcagcataattctaaaaat

SEQ ID NO: 2076 - DNA, 20 bp, Artificial sequence
  Synthetic oligonucleotide
gtggtgcagaaacttctgtt

SEQ ID NO: 2077 - DNA, 20 bp, Artificial sequence
  Synthetic oligonucleotide
taggagttattttataatgc

SEQ ID NO: 2078 - DNA, 20 bp, Artificial sequence
  Synthetic oligonucleotide
taatgcttttcactgaagga

SEQ ID NO: 2079 - DNA, 20 bp, Artificial sequence
  Synthetic oligonucleotide
atgtcaaacaacccccgacc

SEQ ID NO: 2080 - DNA, 20 bp, Artificial sequence
  Synthetic oligonucleotide
ctctttctaattttgtacac

SEQ ID NO: 2081 - DNA, 20 bp, Artificial sequence
  Synthetic oligonucleotide
attatccccccatgagcaca

SEQ ID NO: 2082 - DNA, 20 bp, Artificial sequence
  Synthetic oligonucleotide
aattgagagcttttcctctt

SEQ ID NO: 2083 - DNA, 20 bp, Artificial sequence
  Synthetic oligonucleotide
tcttaacaaaattctagcga

SEQ ID NO: 2084 - DNA, 20 bp, Artificial sequence
  Synthetic oligonucleotide
aaggtaattttataaccccc

SEQ ID NO: 2085 - DNA, 20 bp, Artificial sequence
  Synthetic oligonucleotide
gtataatttttttacctgga

SEQ ID NO: 2086 - DNA, 20 bp, Artificial sequence
  Synthetic oligonucleotide
ttcaatgaaaatcaatatca

SEQ ID NO: 2087 - DNA, 20 bp, Artificial sequence
  Synthetic oligonucleotide
ccaagagtttcagtatagac

SEQ ID NO: 2088 - DNA, 20 bp, Artificial sequence
  Synthetic oligonucleotide
acacacatttcaagtgtcag

SEQ ID NO: 2089 - DNA, 20 bp, Artificial sequence
  Synthetic oligonucleotide
gccacagctatatataggtg

SEQ ID NO: 2090 - DNA, 20 bp, Artificial sequence
  Synthetic oligonucleotide
tcattgcaaaactatccaca

SEQ ID NO: 2091 - DNA, 20 bp, Artificial sequence
  Synthetic oligonucleotide
cactatttgcaattagtgtg

SEQ ID NO: 2092 - DNA, 20 bp, Artificial sequence
  Synthetic oligonucleotide
tctaagatactctctgtcac

SEQ ID NO: 2093 - DNA, 20 bp, Artificial sequence
  Synthetic oligonucleotide
aaggaataatcaaactaaat

SEQ ID NO: 2094 - DNA, 20 bp, Artificial sequence
  Synthetic oligonucleotide
tgttatttcctctgtgctta

SEQ ID NO: 2095 - DNA, 20 bp, Artificial sequence
  Synthetic oligonucleotide
cttccatcacttctcacctg

SEQ ID NO: 2096 - DNA, 20 bp, Artificial sequence
  Synthetic oligonucleotide
gagtgactgaattttctctc

SEQ ID NO: 2097 - DNA, 20 bp, Artificial sequence
  Synthetic oligonucleotide
acattattgaaatgggaagt

SEQ ID NO: 2098 - DNA, 20 bp, Artificial sequence
  Synthetic oligonucleotide
tttttcatctccttcagagc

SEQ ID NO: 2099 - DNA, 20 bp, Artificial sequence
  Synthetic oligonucleotide
ccccttacctttatcaccca

SEQ ID NO: 2100 - DNA, 20 bp, Artificial sequence
  Synthetic oligonucleotide
accatataccatgtacagtt

SEQ ID NO: 2101 - DNA, 20 bp, Artificial sequence
  Synthetic oligonucleotide
tgtgccgtaaaacctataat

SEQ ID NO: 2102 - DNA, 20 bp, Artificial sequence
  Synthetic oligonucleotide
aaatgattgctaaacagtac

SEQ ID NO: 2103 - DNA, 20 bp, Artificial sequence
  Synthetic oligonucleotide
aaatcaaaaatctcttttca

SEQ ID NO: 2104 - DNA, 20 bp, Artificial sequence
  Synthetic oligonucleotide
tccagaatgacaatttatga

SEQ ID NO: 2105 - DNA, 20 bp, Artificial sequence
  Synthetic oligonucleotide
gagtgaattattttcttcta

SEQ ID NO: 2106 - DNA, 20 bp, Artificial sequence
  Synthetic oligonucleotide
atcatctttaattggaaatt

SEQ ID NO: 2107 - DNA, 20 bp, Artificial sequence
  Synthetic oligonucleotide
acacttgcatcagttgatac

SEQ ID NO: 2108 - DNA, 20 bp, Artificial sequence
  Synthetic oligonucleotide
caggtcactccatgtggcca

SEQ ID NO: 2109 - DNA, 20 bp, Artificial sequence
  Synthetic oligonucleotide
tgaggctgcccccagccacc

SEQ ID NO: 2110 - DNA, 20 bp, Artificial sequence
  Synthetic oligonucleotide
gtaacggtcctcatagtcac

SEQ ID NO: 2111 - DNA, 20 bp, Artificial sequence
  Synthetic oligonucleotide
gatggtgaaaacaggaagac

SEQ ID NO: 2112 - DNA, 20 bp, Artificial sequence
  Synthetic oligonucleotide
tgttatacttttactggcct

SEQ ID NO: 2113 - DNA, 20 bp, Artificial sequence
  Synthetic oligonucleotide
tagctatgaaatctctacta

SEQ ID NO: 2114 - DNA, 20 bp, Artificial sequence
  Synthetic oligonucleotide
aggatttttttgaataagta

SEQ ID NO: 2115 - DNA, 20 bp, Artificial sequence
  Synthetic oligonucleotide
acaatatttactcttgttga

SEQ ID NO: 2116 - DNA, 20 bp, Artificial sequence
  Synthetic oligonucleotide
gttcactgtgaatatgtcct

SEQ ID NO: 2117 - DNA, 20 bp, Artificial sequence
  Synthetic oligonucleotide
cagaagcctttcatatatgt

SEQ ID NO: 2118 - DNA, 20 bp, Artificial sequence
  Synthetic oligonucleotide
ccaagggcaccattcccaaa

SEQ ID NO: 2119 - DNA, 20 bp, Artificial sequence
  Synthetic oligonucleotide
ttcagctgccttaattacct

SEQ ID NO: 2120 - DNA, 20 bp, Artificial sequence
  Synthetic oligonucleotide
aaggagatttgccttcagtg

SEQ ID NO: 2121 - DNA, 20 bp, Artificial sequence
  Synthetic oligonucleotide
tgcagctctcctgtatgtca

SEQ ID NO: 2122 - DNA, 20 bp, Artificial sequence
  Synthetic oligonucleotide
acatcatcctctatgatgat

SEQ ID NO: 2123 - DNA, 20 bp, Artificial sequence
  Synthetic oligonucleotide
tttctttgcacactgaccat

SEQ ID NO: 2124 - DNA, 20 bp, Artificial sequence
  Synthetic oligonucleotide
ggtttttgacaattatgaga

SEQ ID NO: 2125 - DNA, 20 bp, Artificial sequence
  Synthetic oligonucleotide
gattcaaaagccaattacag

SEQ ID NO: 2126 - DNA, 20 bp, Artificial sequence
  Synthetic oligonucleotide
atattttttagattgtctcc

SEQ ID NO: 2127 - DNA, 20 bp, Artificial sequence
  Synthetic oligonucleotide
caatcatatttctgtcatct

SEQ ID NO: 2128 - DNA, 20 bp, Artificial sequence
  Synthetic oligonucleotide
ttaacagaatttctttttcc

SEQ ID NO: 2129 - DNA, 20 bp, Artificial sequence
  Synthetic oligonucleotide
gtgacaatatcaaacaattc

SEQ ID NO: 2130 - DNA, 20 bp, Artificial sequence
  Synthetic oligonucleotide
aaagtgcaagccaataataa

SEQ ID NO: 2131 - DNA, 20 bp, Artificial sequence
  Synthetic oligonucleotide
acacttcagatgttaactgc

SEQ ID NO: 2132 - DNA, 20 bp, Artificial sequence
  Synthetic oligonucleotide
acattgtaagcctaaggacc

SEQ ID NO: 2133 - DNA, 20 bp, Artificial sequence
  Synthetic oligonucleotide
tttttatataacaaaacaag

SEQ ID NO: 2134 - DNA, 20 bp, Artificial sequence
  Synthetic oligonucleotide
tgatgctctcagaacaagaa

SEQ ID NO: 2135 - DNA, 20 bp, Artificial sequence
  Synthetic oligonucleotide
tccttaatcctattctacca

SEQ ID NO: 2136 - DNA, 20 bp, Artificial sequence
  Synthetic oligonucleotide
ttatccaattccctgttcct

SEQ ID NO: 2137 - DNA, 20 bp, Artificial sequence
  Synthetic oligonucleotide
tgttgatttttccagaagtt

SEQ ID NO: 2138 - DNA, 20 bp, Artificial sequence
  Synthetic oligonucleotide
gtaagtaaaattgctccttt

SEQ ID NO: 2139 - DNA, 20 bp, Artificial sequence
  Synthetic oligonucleotide
aaatcacatcctacccctct

SEQ ID NO: 2140 - DNA, 20 bp, Artificial sequence
  Synthetic oligonucleotide
tcttaatattttcctttcgg

SEQ ID NO: 2141 - DNA, 20 bp, Artificial sequence
  Synthetic oligonucleotide
atgactcatcattttgccat

SEQ ID NO: 2142 - DNA, 20 bp, Artificial sequence
  Synthetic oligonucleotide
gttattttaatagatgtaaa

SEQ ID NO: 2143 - DNA, 20 bp, Artificial sequence
  Synthetic oligonucleotide
tcatttcctccattctatga

SEQ ID NO: 2144 - DNA, 20 bp, Artificial sequence
  Synthetic oligonucleotide
ttaacaaaatgtttgtcact

SEQ ID NO: 2145 - DNA, 20 bp, Artificial sequence
  Synthetic oligonucleotide
ctaattttagatcattctgc

SEQ ID NO: 2146 - DNA, 20 bp, Artificial sequence
  Synthetic oligonucleotide
catttcagttaatgtgtcat

SEQ ID NO: 2147 - DNA, 20 bp, Artificial sequence
  Synthetic oligonucleotide
tttttccccacatatcacag

SEQ ID NO: 2148 - DNA, 20 bp, Artificial sequence
  Synthetic oligonucleotide
tcagatttttcacatatgcg

SEQ ID NO: 2149 - DNA, 20 bp, Artificial sequence
  Synthetic oligonucleotide
agtgagagcaatatattcac

SEQ ID NO: 2150 - DNA, 20 bp, Artificial sequence
  Synthetic oligonucleotide
ccaatacacaaattactaaa

SEQ ID NO: 2151 - DNA, 20 bp, Artificial sequence
  Synthetic oligonucleotide
agagcttgtgatcacagcct

SEQ ID NO: 2152 - DNA, 20 bp, Artificial sequence
  Synthetic oligonucleotide
ccttacataattcagcataa

SEQ ID NO: 2153 - DNA, 20 bp, Artificial sequence
  Synthetic oligonucleotide
gccatgttcagtgtcagtgt

SEQ ID NO: 2154 - DNA, 20 bp, Artificial sequence
  Synthetic oligonucleotide
cttaggagttattttataat

SEQ ID NO: 2155 - DNA, 20 bp, Artificial sequence
  Synthetic oligonucleotide
tataatgcttttcactgaag

SEQ ID NO: 2156 - DNA, 20 bp, Artificial sequence
  Synthetic oligonucleotide
ggcaaatgtcaaacaacccc

SEQ ID NO: 2157 - DNA, 20 bp, Artificial sequence
  Synthetic oligonucleotide
tctctttctaattttgtaca

SEQ ID NO: 2158 - DNA, 20 bp, Artificial sequence
  Synthetic oligonucleotide
cattaattatccccccatga

SEQ ID NO: 2159 - DNA, 20 bp, Artificial sequence
  Synthetic oligonucleotide
ccacatatgacaaggtcaca

SEQ ID NO: 2160 - DNA, 20 bp, Artificial sequence
  Synthetic oligonucleotide
gcagtataggccaatatccc

SEQ ID NO: 2161 - DNA, 20 bp, Artificial sequence
  Synthetic oligonucleotide
aaaggtaattttataacccc

SEQ ID NO: 2162 - DNA, 20 bp, Artificial sequence
  Synthetic oligonucleotide
taggtataatttttttacct

SEQ ID NO: 2163 - DNA, 20 bp, Artificial sequence
  Synthetic oligonucleotide
ttgaaaagttttcaatgaaa

SEQ ID NO: 2164 - DNA, 20 bp, Artificial sequence
  Synthetic oligonucleotide
gccatctactgaaataggac

SEQ ID NO: 2165 - DNA, 20 bp, Artificial sequence
  Synthetic oligonucleotide
aacacacatttcaagtgtca

SEQ ID NO: 2166 - DNA, 20 bp, Artificial sequence
  Synthetic oligonucleotide
gtaccataaccttttttttt

SEQ ID NO: 2167 - DNA, 20 bp, Artificial sequence
  Synthetic oligonucleotide
cggaaatatcattcgactca

SEQ ID NO: 2168 - DNA, 20 bp, Artificial sequence
  Synthetic oligonucleotide
gacactatttgcaattagtg

SEQ ID NO: 2169 - DNA, 20 bp, Artificial sequence
  Synthetic oligonucleotide
atctaagatactctctgtca

SEQ ID NO: 2170 - DNA, 20 bp, Artificial sequence
  Synthetic oligonucleotide
cataaggaataatcaaacta

SEQ ID NO: 2171 - DNA, 20 bp, Artificial sequence
  Synthetic oligonucleotide
atgttatttcctctgtgctt

SEQ ID NO: 2172 - DNA, 20 bp, Artificial sequence
  Synthetic oligonucleotide
tcggtgcttccatcacttct

SEQ ID NO: 2173 - DNA, 20 bp, Artificial sequence
  Synthetic oligonucleotide
tagagtgactgaattttctc

SEQ ID NO: 2174 - DNA, 20 bp, Artificial sequence
  Synthetic oligonucleotide
taacattattgaaatgggaa

SEQ ID NO: 2175 - DNA, 20 bp, Artificial sequence
  Synthetic oligonucleotide
ttatttttcatctccttcag

SEQ ID NO: 2176 - DNA, 20 bp, Artificial sequence
  Synthetic oligonucleotide
accccttacctttatcaccc

SEQ ID NO: 2177 - DNA, 20 bp, Artificial sequence
  Synthetic oligonucleotide
caccatataccatgtacagt

SEQ ID NO: 2178 - DNA, 20 bp, Artificial sequence
  Synthetic oligonucleotide
gtgtgccgtaaaacctataa

SEQ ID NO: 2179 - DNA, 20 bp, Artificial sequence
  Synthetic oligonucleotide
atgacaatagtaaaatgatt

SEQ ID NO: 2180 - DNA, 20 bp, Artificial sequence
  Synthetic oligonucleotide
caaatcaaaaatctcttttc

SEQ ID NO: 2181 - DNA, 20 bp, Artificial sequence
  Synthetic oligonucleotide
catccagaatgacaatttat

SEQ ID NO: 2182 - DNA, 20 bp, Artificial sequence
  Synthetic oligonucleotide
ttatgagtgaattattttct

SEQ ID NO: 2183 - DNA, 20 bp, Artificial sequence
  Synthetic oligonucleotide
tgctctgaaaagcgaagcca

SEQ ID NO: 2184 - DNA, 20 bp, Artificial sequence
  Synthetic oligonucleotide
ggttcgccataatgactgct

SEQ ID NO: 2185 - DNA, 20 bp, Artificial sequence
  Synthetic oligonucleotide
caaggttcgccataatgact

SEQ ID NO: 2186 - DNA, 20 bp, Artificial sequence
  Synthetic oligonucleotide
gttccatcctccaggcttcg

SEQ ID NO: 2187 - DNA, 20 bp, Artificial sequence
  Synthetic oligonucleotide
tgttccatcctccaggcttc

SEQ ID NO: 2188 - DNA, 20 bp, Artificial sequence
  Synthetic oligonucleotide
tgcccccagtgttccatcct

SEQ ID NO: 2189 - DNA, 20 bp, Artificial sequence
  Synthetic oligonucleotide
ctgcccccagtgttccatcc

SEQ ID NO: 2190 - DNA, 20 bp, Artificial sequence
  Synthetic oligonucleotide
ctatgttttccagtgcccat

SEQ ID NO: 2191 - DNA, 20 bp, Artificial sequence
  Synthetic oligonucleotide
ctctatgttttccagtgccc

SEQ ID NO: 2192 - DNA, 20 bp, Artificial sequence
  Synthetic oligonucleotide
atttgctgttatacttttac

SEQ ID NO: 2193 - DNA, 20 bp, Artificial sequence
  Synthetic oligonucleotide
tatttgctgttatactttta

SEQ ID NO: 2194 - DNA, 20 bp, Artificial sequence
  Synthetic oligonucleotide
ccaaaaataagtccagatta

SEQ ID NO: 2195 - DNA, 20 bp, Artificial sequence
  Synthetic oligonucleotide
tccaaaaataagtccagatt

SEQ ID NO: 2196 - DNA, 20 bp, Artificial sequence
  Synthetic oligonucleotide
caaaggtatttcagactgtt

SEQ ID NO: 2197 - DNA, 20 bp, Artificial sequence
  Synthetic oligonucleotide
gcaaaggtatttcagactgt

SEQ ID NO: 2198 - DNA, 20 bp, Artificial sequence
  Synthetic oligonucleotide
attagtatactgagctctag

SEQ ID NO: 2199 - DNA, 20 bp, Artificial sequence
  Synthetic oligonucleotide
tagggcattagtatactgag

SEQ ID NO: 2200 - DNA, 20 bp, Artificial sequence
  Synthetic oligonucleotide
ggttttcttaaaatggaaaa

SEQ ID NO: 2201 - DNA, 20 bp, Artificial sequence
  Synthetic oligonucleotide
gtcgggttttcttaaaatgg

SEQ ID NO: 2202 - DNA, 20 bp, Artificial sequence
  Synthetic oligonucleotide
agaggttcagtgttgtgaca

SEQ ID NO: 2203 - DNA, 20 bp, Artificial sequence
  Synthetic oligonucleotide
tatgtcctctagccagaggt

SEQ ID NO: 2204 - DNA, 20 bp, Artificial sequence
  Synthetic oligonucleotide
tatgttcactgtgaatatgt

SEQ ID NO: 2205 - DNA, 20 bp, Artificial sequence
  Synthetic oligonucleotide
catatatgttacagttatgt

SEQ ID NO: 2206 - DNA, 20 bp, Artificial sequence
  Synthetic oligonucleotide
tgatttcaagtcccagaagc

SEQ ID NO: 2207 - DNA, 20 bp, Artificial sequence
  Synthetic oligonucleotide
acatatagggtcctttaaac

SEQ ID NO: 2208 - DNA, 20 bp, Artificial sequence
  Synthetic oligonucleotide
aaaggaatgccacatatagg

SEQ ID NO: 2209 - DNA, 20 bp, Artificial sequence
  Synthetic oligonucleotide
agaaaggaatgccacatata

SEQ ID NO: 2210 - DNA, 20 bp, Artificial sequence
  Synthetic oligonucleotide
acttttcagctgccttaatt

SEQ ID NO: 2211 - DNA, 20 bp, Artificial sequence
  Synthetic oligonucleotide
tacttttcagctgccttaat

SEQ ID NO: 2212 - DNA, 20 bp, Artificial sequence
  Synthetic oligonucleotide
aaaatcattctggtttccag

SEQ ID NO: 2213 - DNA, 20 bp, Artificial sequence
  Synthetic oligonucleotide
caaaatcattctggtttcca

SEQ ID NO: 2214 - DNA, 20 bp, Artificial sequence
  Synthetic oligonucleotide
tttgcacactgaccattttt

SEQ ID NO: 2215 - DNA, 20 bp, Artificial sequence
  Synthetic oligonucleotide
ctttgcacactgaccatttt

SEQ ID NO: 2216 - DNA, 20 bp, Artificial sequence
  Synthetic oligonucleotide
tggtttttgacaattatgag

SEQ ID NO: 2217 - DNA, 20 bp, Artificial sequence
  Synthetic oligonucleotide
ctggtttttgacaattatga

SEQ ID NO: 2218 - DNA, 20 bp, Artificial sequence
  Synthetic oligonucleotide
tcatctccaacctaagatat

SEQ ID NO: 2219 - DNA, 20 bp, Artificial sequence
  Synthetic oligonucleotide
ttctttttccacttcaaatc

SEQ ID NO: 2220 - DNA, 20 bp, Artificial sequence
  Synthetic oligonucleotide
gggaataattttactttaat

SEQ ID NO: 2221 - DNA, 20 bp, Artificial sequence
  Synthetic oligonucleotide
agggaataattttactttaa

SEQ ID NO: 2222 - DNA, 20 bp, Artificial sequence
  Synthetic oligonucleotide
ccaataataacattgcagaa

SEQ ID NO: 2223 - DNA, 20 bp, Artificial sequence
  Synthetic oligonucleotide
agccaataataacattgcag

SEQ ID NO: 2224 - DNA, 20 bp, Artificial sequence
  Synthetic oligonucleotide
tttcccacatattaagtatt

SEQ ID NO: 2225 - DNA, 20 bp, Artificial sequence
  Synthetic oligonucleotide
agggtttcccacatattaag

SEQ ID NO: 2226 - DNA, 20 bp, Artificial sequence
  Synthetic oligonucleotide
ttcagtgcacattgtaagcc

SEQ ID NO: 2227 - DNA, 20 bp, Artificial sequence
  Synthetic oligonucleotide
ttccagaagtttaacatatt

SEQ ID NO: 2228 - DNA, 20 bp, Artificial sequence
  Synthetic oligonucleotide
agcgttgttgatttttccag

SEQ ID NO: 2229 - DNA, 20 bp, Artificial sequence
  Synthetic oligonucleotide
tttttttcactgtaagacct

SEQ ID NO: 2230 - DNA, 20 bp, Artificial sequence
  Synthetic oligonucleotide
agacttgtgttagatataaa

SEQ ID NO: 2231 - DNA, 20 bp, Artificial sequence
  Synthetic oligonucleotide
cggtgtggaagacttgtgtt

SEQ ID NO: 2232 - DNA, 20 bp, Artificial sequence
  Synthetic oligonucleotide
attttaatagatgtaaaatg

SEQ ID NO: 2233 - DNA, 20 bp, Artificial sequence
  Synthetic oligonucleotide
caggtaagttctcaggagtg

SEQ ID NO: 2234 - DNA, 20 bp, Artificial sequence
  Synthetic oligonucleotide
gtttcttccattgcaggtaa

SEQ ID NO: 2235 - DNA, 20 bp, Artificial sequence
  Synthetic oligonucleotide
gtttgtttgtttcttccatt

SEQ ID NO: 2236 - DNA, 20 bp, Artificial sequence
  Synthetic oligonucleotide
tatacatttaggctcttttc

SEQ ID NO: 2237 - DNA, 20 bp, Artificial sequence
  Synthetic oligonucleotide
cataattttcttagctactg

SEQ ID NO: 2238 - DNA, 20 bp, Artificial sequence
  Synthetic oligonucleotide
ttttagtggttacataatgt

SEQ ID NO: 2239 - DNA, 20 bp, Artificial sequence
  Synthetic oligonucleotide
gatttttcacatatgcgttc

SEQ ID NO: 2240 - DNA, 20 bp, Artificial sequence
  Synthetic oligonucleotide
gtgcttttcctttcagattt

SEQ ID NO: 2241 - DNA, 20 bp, Artificial sequence
  Synthetic oligonucleotide
aatatattcaccaaaggaaa

SEQ ID NO: 2242 - DNA, 20 bp, Artificial sequence
  Synthetic oligonucleotide
atctgttgtggttcagctaa

SEQ ID NO: 2243 - DNA, 20 bp, Artificial sequence
  Synthetic oligonucleotide
tatgtacaatctgttgtggt

SEQ ID NO: 2244 - DNA, 20 bp, Artificial sequence
  Synthetic oligonucleotide
cttctgttatgttattattg

SEQ ID NO: 2245 - DNA, 20 bp, Artificial sequence
  Synthetic oligonucleotide
taattagttacatcgggaag

SEQ ID NO: 2246 - DNA, 20 bp, Artificial sequence
  Synthetic oligonucleotide
tagtaagaacttatcccaag

SEQ ID NO: 2247 - DNA, 20 bp, Artificial sequence
  Synthetic oligonucleotide
atggcactttctttttattt

SEQ ID NO: 2248 - DNA, 20 bp, Artificial sequence
  Synthetic oligonucleotide
cacaggctatctttctattt

SEQ ID NO: 2249 - DNA, 20 bp, Artificial sequence
  Synthetic oligonucleotide
gatttttggacgggagattt

SEQ ID NO: 2250 - DNA, 20 bp, Artificial sequence
  Synthetic oligonucleotide
ggatctcttagatttttgga

SEQ ID NO: 2251 - DNA, 20 bp, Artificial sequence
  Synthetic oligonucleotide
tttgctttggatctcttaga

SEQ ID NO: 2252 - DNA, 20 bp, Artificial sequence
  Synthetic oligonucleotide
cagggtggtagtttttcaaa

SEQ ID NO: 2253 - DNA, 20 bp, Artificial sequence
  Synthetic oligonucleotide
attaataggttaggaagaaa

SEQ ID NO: 2254 - DNA, 20 bp, Artificial sequence
  Synthetic oligonucleotide
ggagctctattaataggtta

SEQ ID NO: 2255 - DNA, 20 bp, Artificial sequence
  Synthetic oligonucleotide
gtgggagtatcaatttaagc

SEQ ID NO: 2256 - DNA, 20 bp, Artificial sequence
  Synthetic oligonucleotide
tgttgtttcttttctggtag

SEQ ID NO: 2257 - DNA, 20 bp, Artificial sequence
  Synthetic oligonucleotide
ttatttcctctgtgcttatt

SEQ ID NO: 2258 - DNA, 20 bp, Artificial sequence
  Synthetic oligonucleotide
tttttggaggctcttttagg

SEQ ID NO: 2259 - DNA, 20 bp, Artificial sequence
  Synthetic oligonucleotide
ccatataccatgtacagttc

SEQ ID NO: 2260 - DNA, 20 bp, Artificial sequence
  Synthetic oligonucleotide
ggatgatctgcaattgtttt

SEQ ID NO: 2261 - DNA, 20 bp, Artificial sequence
  Synthetic oligonucleotide
gccaaggttcgccataatga

SEQ ID NO: 2262 - DNA, 20 bp, Artificial sequence
  Synthetic oligonucleotide
agtgttccatcctccaggct

SEQ ID NO: 2263 - DNA, 20 bp, Artificial sequence
  Synthetic oligonucleotide
gctgcccccagtgttccatc

SEQ ID NO: 2264 - DNA, 20 bp, Artificial sequence
  Synthetic oligonucleotide
actctatgttttccagtgcc

SEQ ID NO: 2265 - DNA, 20 bp, Artificial sequence
  Synthetic oligonucleotide
ttatttgctgttatactttt

SEQ ID NO: 2266 - DNA, 20 bp, Artificial sequence
  Synthetic oligonucleotide
agtccaaaaataagtccaga

SEQ ID NO: 2267 - DNA, 20 bp, Artificial sequence
  Synthetic oligonucleotide
aggcaaaggtatttcagact

SEQ ID NO: 2268 - DNA, 20 bp, Artificial sequence
  Synthetic oligonucleotide
atagggcattagtatactga

SEQ ID NO: 2269 - DNA, 20 bp, Artificial sequence
  Synthetic oligonucleotide
tgtcgggttttcttaaaatg

SEQ ID NO: 2270 - DNA, 20 bp, Artificial sequence
  Synthetic oligonucleotide
aatatgtcctctagccagag

SEQ ID NO: 2271 - DNA, 20 bp, Artificial sequence
  Synthetic oligonucleotide
tcatatatgttacagttatg

SEQ ID NO: 2272 - DNA, 20 bp, Artificial sequence
  Synthetic oligonucleotide
cacatatagggtcctttaaa

SEQ ID NO: 2273 - DNA, 20 bp, Artificial sequence
  Synthetic oligonucleotide
ttaattacctatagtttaaa

SEQ ID NO: 2274 - DNA, 20 bp, Artificial sequence
  Synthetic oligonucleotide
ttacttttcagctgccttaa

SEQ ID NO: 2275 - DNA, 20 bp, Artificial sequence
  Synthetic oligonucleotide
ctcctgtatgtcaaaatcat

SEQ ID NO: 2276 - DNA, 20 bp, Artificial sequence
  Synthetic oligonucleotide
aatgcaagcagttcttttct

SEQ ID NO: 2277 - DNA, 20 bp, Artificial sequence
  Synthetic oligonucleotide
tctggtttttgacaattatg

SEQ ID NO: 2278 - DNA, 20 bp, Artificial sequence
  Synthetic oligonucleotide
tttctttttccacttcaaat

SEQ ID NO: 2279 - DNA, 20 bp, Artificial sequence
  Synthetic oligonucleotide
caattcagggaataatttta

SEQ ID NO: 2280 - DNA, 20 bp, Artificial sequence
  Synthetic oligonucleotide
caagccaataataacattgc

SEQ ID NO: 2281 - DNA, 20 bp, Artificial sequence
  Synthetic oligonucleotide
cacattgtaagcctaaggac

SEQ ID NO: 2282 - DNA, 20 bp, Artificial sequence
  Synthetic oligonucleotide
tttttccagaagtttaacat

SEQ ID NO: 2283 - DNA, 20 bp, Artificial sequence
  Synthetic oligonucleotide
agagcgttgttgatttttcc

SEQ ID NO: 2284 - DNA, 20 bp, Artificial sequence
  Synthetic oligonucleotide
ttttttcctttcttctacaa

SEQ ID NO: 2285 - DNA, 20 bp, Artificial sequence
  Synthetic oligonucleotide
gctttttttcactgtaagac

SEQ ID NO: 2286 - DNA, 20 bp, Artificial sequence
  Synthetic oligonucleotide
agctttttttcactgtaaga

SEQ ID NO: 2287 - DNA, 20 bp, Artificial sequence
  Synthetic oligonucleotide
aagacttgtgttagatataa

SEQ ID NO: 2288 - DNA, 20 bp, Artificial sequence
  Synthetic oligonucleotide
gaagacttgtgttagatata

SEQ ID NO: 2289 - DNA, 20 bp, Artificial sequence
  Synthetic oligonucleotide
tcatcattttgccatttatc

SEQ ID NO: 2290 - DNA, 20 bp, Artificial sequence
  Synthetic oligonucleotide
ctcatcattttgccatttat

SEQ ID NO: 2291 - DNA, 20 bp, Artificial sequence
  Synthetic oligonucleotide
ttattttaatagatgtaaaa

SEQ ID NO: 2292 - DNA, 20 bp, Artificial sequence
  Synthetic oligonucleotide
ggttattttaatagatgtaa

SEQ ID NO: 2293 - DNA, 20 bp, Artificial sequence
  Synthetic oligonucleotide
tgcaggtaagttctcaggag

SEQ ID NO: 2294 - DNA, 20 bp, Artificial sequence
  Synthetic oligonucleotide
attgcaggtaagttctcagg

SEQ ID NO: 2295 - DNA, 20 bp, Artificial sequence
  Synthetic oligonucleotide
ttgtttcttccattgcaggt

SEQ ID NO: 2296 - DNA, 20 bp, Artificial sequence
  Synthetic oligonucleotide
tttgtttcttccattgcagg

SEQ ID NO: 2297 - DNA, 20 bp, Artificial sequence
  Synthetic oligonucleotide
ttgtttgtttgtttcttcca

SEQ ID NO: 2298 - DNA, 20 bp, Artificial sequence
  Synthetic oligonucleotide
ggctcttttccaggtgttct

SEQ ID NO: 2299 - DNA, 20 bp, Artificial sequence
  Synthetic oligonucleotide
ttatacatttaggctctttt

SEQ ID NO: 2300 - DNA, 20 bp, Artificial sequence
  Synthetic oligonucleotide
tgttatacatttaggctctt

SEQ ID NO: 2301 - DNA, 20 bp, Artificial sequence
  Synthetic oligonucleotide
tcataattttcttagctact

SEQ ID NO: 2302 - DNA, 20 bp, Artificial sequence
  Synthetic oligonucleotide
gtgtcataattttcttagct

SEQ ID NO: 2303 - DNA, 20 bp, Artificial sequence
  Synthetic oligonucleotide
gtttttccccacatatcaca

SEQ ID NO: 2304 - DNA, 20 bp, Artificial sequence
  Synthetic oligonucleotide
gtcagtttttccccacatat

SEQ ID NO: 2305 - DNA, 20 bp, Artificial sequence
  Synthetic oligonucleotide
agatttttcacatatgcgtt

SEQ ID NO: 2306 - DNA, 20 bp, Artificial sequence
  Synthetic oligonucleotide
cagatttttcacatatgcgt

SEQ ID NO: 2307 - DNA, 20 bp, Artificial sequence
  Synthetic oligonucleotide
ctgtgcttttcctttcagat

SEQ ID NO: 2308 - DNA, 20 bp, Artificial sequence
  Synthetic oligonucleotide
ttctgtgcttttcctttcag

SEQ ID NO: 2309 - DNA, 20 bp, Artificial sequence
  Synthetic oligonucleotide
caatatattcaccaaaggaa

SEQ ID NO: 2310 - DNA, 20 bp, Artificial sequence
  Synthetic oligonucleotide
agcaatatattcaccaaagg

SEQ ID NO: 2311 - DNA, 20 bp, Artificial sequence
  Synthetic oligonucleotide
aatctgttgtggttcagcta

SEQ ID NO: 2312 - DNA, 20 bp, Artificial sequence
  Synthetic oligonucleotide
caatctgttgtggttcagct

SEQ ID NO: 2313 - DNA, 20 bp, Artificial sequence
  Synthetic oligonucleotide
atgttattattgttatttga

SEQ ID NO: 2314 - DNA, 20 bp, Artificial sequence
  Synthetic oligonucleotide
ttatgttattattgttattt

SEQ ID NO: 2315 - DNA, 20 bp, Artificial sequence
  Synthetic oligonucleotide
aacttctgttatgttattat

SEQ ID NO: 2316 - DNA, 20 bp, Artificial sequence
  Synthetic oligonucleotide
cagagaatctttcaccttgg

SEQ ID NO: 2317 - DNA, 20 bp, Artificial sequence
  Synthetic oligonucleotide
ttaattagttacatcgggaa

SEQ ID NO: 2318 - DNA, 20 bp, Artificial sequence
  Synthetic oligonucleotide
aagcttaattagttacatcg

SEQ ID NO: 2319 - DNA, 20 bp, Artificial sequence
  Synthetic oligonucleotide
gagctagtaagaacttatcc

SEQ ID NO: 2320 - DNA, 20 bp, Artificial sequence
  Synthetic oligonucleotide
cagagctagtaagaacttat

SEQ ID NO: 2321 - DNA, 20 bp, Artificial sequence
  Synthetic oligonucleotide
aaatggcactttctttttat

SEQ ID NO: 2322 - DNA, 20 bp, Artificial sequence
  Synthetic oligonucleotide
ctttctatttgtgtctcctt

SEQ ID NO: 2323 - DNA, 20 bp, Artificial sequence
  Synthetic oligonucleotide
gcacaggctatctttctatt

SEQ ID NO: 2324 - DNA, 20 bp, Artificial sequence
  Synthetic oligonucleotide
gagcacaggctatctttcta

SEQ ID NO: 2325 - DNA, 20 bp, Artificial sequence
  Synthetic oligonucleotide
tagatttttggacgggagat

SEQ ID NO: 2326 - DNA, 20 bp, Artificial sequence
  Synthetic oligonucleotide
ttagatttttggacgggaga

SEQ ID NO: 2327 - DNA, 20 bp, Artificial sequence
  Synthetic oligonucleotide
ttggatctcttagatttttg

SEQ ID NO: 2328 - DNA, 20 bp, Artificial sequence
  Synthetic oligonucleotide
tgtttgctttggatctctta

SEQ ID NO: 2329 - DNA, 20 bp, Artificial sequence
  Synthetic oligonucleotide
atttttttacctggaaaatc

SEQ ID NO: 2330 - DNA, 20 bp, Artificial sequence
  Synthetic oligonucleotide
tattaataggttaggaagaa

SEQ ID NO: 2331 - DNA, 20 bp, Artificial sequence
  Synthetic oligonucleotide
caggagctctattaataggt

SEQ ID NO: 2332 - DNA, 20 bp, Artificial sequence
  Synthetic oligonucleotide
agtgggagtatcaatttaag

SEQ ID NO: 2333 - DNA, 20 bp, Artificial sequence
  Synthetic oligonucleotide
tgttgttgtttcttttctgg

SEQ ID NO: 2334 - DNA, 20 bp, Artificial sequence
  Synthetic oligonucleotide
gttatttcctctgtgcttat

SEQ ID NO: 2335 - DNA, 20 bp, Artificial sequence
  Synthetic oligonucleotide
gtttttggaggctcttttag

SEQ ID NO: 2336 - DNA, 20 bp, Artificial sequence
  Synthetic oligonucleotide
tcaccatataccatgtacag

SEQ ID NO: 2337 - DNA, 20 bp, Artificial sequence
  Synthetic oligonucleotide
ctgggatgatctgcaattgt

SEQ ID NO: 2338 - DNA, 20 bp, Artificial sequence
  Synthetic oligonucleotide
cagccaaggttcgccataat

SEQ ID NO: 2339 - DNA, 20 bp, Artificial sequence
  Synthetic oligonucleotide
ccatcctccaggcttcgggc

SEQ ID NO: 2340 - DNA, 20 bp, Artificial sequence
  Synthetic oligonucleotide
ccagtgttccatcctccagg

SEQ ID NO: 2341 - DNA, 20 bp, Artificial sequence
  Synthetic oligonucleotide
cccccagtgttccatcctcc

SEQ ID NO: 2342 - DNA, 20 bp, Artificial sequence
  Synthetic oligonucleotide
gttttccagtgcccatcagt

SEQ ID NO: 2343 - DNA, 20 bp, Artificial sequence
  Synthetic oligonucleotide
atgttttccagtgcccatca

SEQ ID NO: 2344 - DNA, 20 bp, Artificial sequence
  Synthetic oligonucleotide
tactctatgttttccagtgc

SEQ ID NO: 2345 - DNA, 20 bp, Artificial sequence
  Synthetic oligonucleotide
tgctgttatacttttactgg

SEQ ID NO: 2346 - DNA, 20 bp, Artificial sequence
  Synthetic oligonucleotide
ggttatttgctgttatactt

SEQ ID NO: 2347 - DNA, 20 bp, Artificial sequence
  Synthetic oligonucleotide
aaaataagtccagattaacc

SEQ ID NO: 2348 - DNA, 20 bp, Artificial sequence
  Synthetic oligonucleotide
aagtccaaaaataagtccag

SEQ ID NO: 2349 - DNA, 20 bp, Artificial sequence
  Synthetic oligonucleotide
aggtatttcagactgttctg

SEQ ID NO: 2350 - DNA, 20 bp, Artificial sequence
  Synthetic oligonucleotide
caggcaaaggtatttcagac

SEQ ID NO: 2351 - DNA, 20 bp, Artificial sequence
  Synthetic oligonucleotide
ccaggcaaaggtatttcaga

SEQ ID NO: 2352 - DNA, 20 bp, Artificial sequence
  Synthetic oligonucleotide
gatagggcattagtatactg

SEQ ID NO: 2353 - DNA, 20 bp, Artificial sequence
  Synthetic oligonucleotide
aagatagggcattagtatac

SEQ ID NO: 2354 - DNA, 20 bp, Artificial sequence
  Synthetic oligonucleotide
gttgtcgggttttcttaaaa

SEQ ID NO: 2355 - DNA, 20 bp, Artificial sequence
  Synthetic oligonucleotide
cagtgttgtgacaatattta

SEQ ID NO: 2356 - DNA, 20 bp, Artificial sequence
  Synthetic oligonucleotide
gaatatgtcctctagccaga

SEQ ID NO: 2357 - DNA, 20 bp, Artificial sequence
  Synthetic oligonucleotide
actgtgaatatgtcctctag

SEQ ID NO: 2358 - DNA, 20 bp, Artificial sequence
  Synthetic oligonucleotide
agcctttcatatatgttaca

SEQ ID NO: 2359 - DNA, 20 bp, Artificial sequence
  Synthetic oligonucleotide
gaagcctttcatatatgtta

SEQ ID NO: 2360 - DNA, 20 bp, Artificial sequence
  Synthetic oligonucleotide
tgccacatatagggtccttt

SEQ ID NO: 2361 - DNA, 20 bp, Artificial sequence
  Synthetic oligonucleotide
agctgccttaattacctata

SEQ ID NO: 2362 - DNA, 20 bp, Artificial sequence
  Synthetic oligonucleotide
aatttacttttcagctgcct

SEQ ID NO: 2363 - DNA, 20 bp, Artificial sequence
  Synthetic oligonucleotide
ggtgctttcacaactgcagc

SEQ ID NO: 2364 - DNA, 20 bp, Artificial sequence
  Synthetic oligonucleotide
gaaatgcaagcagttctttt

SEQ ID NO: 2365 - DNA, 20 bp, Artificial sequence
  Synthetic oligonucleotide
attctggtttttgacaatta

SEQ ID NO: 2366 - DNA, 20 bp, Artificial sequence
  Synthetic oligonucleotide
atttctttttccacttcaaa

SEQ ID NO: 2367 - DNA, 20 bp, Artificial sequence
  Synthetic oligonucleotide
taataacattgcagaaaagt

SEQ ID NO: 2368 - DNA, 20 bp, Artificial sequence
  Synthetic oligonucleotide
ccacatattaagtattcagt

SEQ ID NO: 2369 - DNA, 20 bp, Artificial sequence
  Synthetic oligonucleotide
gcacattgtaagcctaagga

SEQ ID NO: 2370 - DNA, 20 bp, Artificial sequence
  Synthetic oligonucleotide
tgatttttccagaagtttaa

SEQ ID NO: 2371 - DNA, 20 bp, Artificial sequence
  Synthetic oligonucleotide
attttttcctttcttctaca

SEQ ID NO: 2372 - DNA, 20 bp, Artificial sequence
  Synthetic oligonucleotide
ttactggttagctttttttc

SEQ ID NO: 2373 - DNA, 20 bp, Artificial sequence
  Synthetic oligonucleotide
ggaagacttgtgttagatat

SEQ ID NO: 2374 - DNA, 20 bp, Artificial sequence
  Synthetic oligonucleotide
gactcatcattttgccattt

SEQ ID NO: 2375 - DNA, 20 bp, Artificial sequence
  Synthetic oligonucleotide
tttggttattttaatagatg

SEQ ID NO: 2376 - DNA, 20 bp, Artificial sequence
  Synthetic oligonucleotide
cattgcaggtaagttctcag

SEQ ID NO: 2377 - DNA, 20 bp, Artificial sequence
  Synthetic oligonucleotide
gtttgtttcttccattgcag

SEQ ID NO: 2378 - DNA, 20 bp, Artificial sequence
  Synthetic oligonucleotide
catttaggctcttttccagg

SEQ ID NO: 2379 - DNA, 20 bp, Artificial sequence
  Synthetic oligonucleotide
cctggtgttatacatttagg

SEQ ID NO: 2380 - DNA, 20 bp, Artificial sequence
  Synthetic oligonucleotide
ttacataatgttcatttcag

SEQ ID NO: 2381 - DNA, 20 bp, Artificial sequence
  Synthetic oligonucleotide
tttacttgtcagtttttccc

SEQ ID NO: 2382 - DNA, 20 bp, Artificial sequence
  Synthetic oligonucleotide
tcctttcagatttttcacat

SEQ ID NO: 2383 - DNA, 20 bp, Artificial sequence
  Synthetic oligonucleotide
ttttctgtgcttttcctttc

SEQ ID NO: 2384 - DNA, 20 bp, Artificial sequence
  Synthetic oligonucleotide
gtgagagcaatatattcacc

SEQ ID NO: 2385 - DNA, 20 bp, Artificial sequence
  Synthetic oligonucleotide
tacaatctgttgtggttcag

SEQ ID NO: 2386 - DNA, 20 bp, Artificial sequence
  Synthetic oligonucleotide
gttatgttattattgttatt

SEQ ID NO: 2387 - DNA, 20 bp, Artificial sequence
  Synthetic oligonucleotide
tcagagaatctttcaccttg

SEQ ID NO: 2388 - DNA, 20 bp, Artificial sequence
  Synthetic oligonucleotide
ttgaagcttaattagttaca

SEQ ID NO: 2389 - DNA, 20 bp, Artificial sequence
  Synthetic oligonucleotide
cactttctttttatttcttt

SEQ ID NO: 2390 - DNA, 20 bp, Artificial sequence
  Synthetic oligonucleotide
atctttctatttgtgtctcc

SEQ ID NO: 2391 - DNA, 20 bp, Artificial sequence
  Synthetic oligonucleotide
tgagcacaggctatctttct

SEQ ID NO: 2392 - DNA, 20 bp, Artificial sequence
  Synthetic oligonucleotide
cttagatttttggacgggag

SEQ ID NO: 2393 - DNA, 20 bp, Artificial sequence
  Synthetic oligonucleotide
tttggatctcttagattttt

SEQ ID NO: 2394 - DNA, 20 bp, Artificial sequence
  Synthetic oligonucleotide
ctttggatctcttagatttt

SEQ ID NO: 2395 - DNA, 20 bp, Artificial sequence
  Synthetic oligonucleotide
gtttttcaaatcaacaaatc

SEQ ID NO: 2396 - DNA, 20 bp, Artificial sequence
  Synthetic oligonucleotide
tagtttttcaaatcaacaaa

SEQ ID NO: 2397 - DNA, 20 bp, Artificial sequence
  Synthetic oligonucleotide
taatttttttacctggaaaa

SEQ ID NO: 2398 - DNA, 20 bp, Artificial sequence
  Synthetic oligonucleotide
ataatttttttacctggaaa

SEQ ID NO: 2399 - DNA, 20 bp, Artificial sequence
  Synthetic oligonucleotide
ctattaataggttaggaaga

SEQ ID NO: 2400 - DNA, 20 bp, Artificial sequence
  Synthetic oligonucleotide
tctattaataggttaggaag

SEQ ID NO: 2401 - DNA, 20 bp, Artificial sequence
  Synthetic oligonucleotide
tcaggagctctattaatagg

SEQ ID NO: 2402 - DNA, 20 bp, Artificial sequence
  Synthetic oligonucleotide
gtatcaatttaagcaattgt

SEQ ID NO: 2403 - DNA, 20 bp, Artificial sequence
  Synthetic oligonucleotide
aagtgggagtatcaatttaa

SEQ ID NO: 2404 - DNA, 20 bp, Artificial sequence
  Synthetic oligonucleotide
tcaagtgggagtatcaattt

SEQ ID NO: 2405 - DNA, 20 bp, Artificial sequence
  Synthetic oligonucleotide
ttgttgttgtttcttttctg

SEQ ID NO: 2406 - DNA, 20 bp, Artificial sequence
  Synthetic oligonucleotide
tttgttgttgtttcttttct

SEQ ID NO: 2407 - DNA, 20 bp, Artificial sequence
  Synthetic oligonucleotide
tatgttatttcctctgtgct

SEQ ID NO: 2408 - DNA, 20 bp, Artificial sequence
  Synthetic oligonucleotide
tattatgttatttcctctgt

SEQ ID NO: 2409 - DNA, 20 bp, Artificial sequence
  Synthetic oligonucleotide
gggtttttggaggctctttt

SEQ ID NO: 2410 - DNA, 20 bp, Artificial sequence
  Synthetic oligonucleotide
ataccatgtacagttcaatg

SEQ ID NO: 2411 - DNA, 20 bp, Artificial sequence
  Synthetic oligonucleotide
ttcaccatataccatgtaca

SEQ ID NO: 2412 - DNA, 20 bp, Artificial sequence
  Synthetic oligonucleotide
aattcaccatataccatgta

SEQ ID NO: 2413 - DNA, 20 bp, Artificial sequence
  Synthetic oligonucleotide
gctgggatgatctgcaattg

SEQ ID NO: 2414 - DNA, 20 bp, Artificial sequence
  Synthetic oligonucleotide
gtgctgggatgatctgcaat

SEQ ID NO: 2415 - DNA, 20 bp, Artificial sequence
  Synthetic oligonucleotide
ttccatcctccaggcttcgg

SEQ ID NO: 2416 - DNA, 20 bp, Artificial sequence
  Synthetic oligonucleotide
gcccccagtgttccatcctc

SEQ ID NO: 2417 - DNA, 20 bp, Artificial sequence
  Synthetic oligonucleotide
tatgttttccagtgcccatc

SEQ ID NO: 2418 - DNA, 20 bp, Artificial sequence
  Synthetic oligonucleotide
ttgctgttatacttttactg

SEQ ID NO: 2419 - DNA, 20 bp, Artificial sequence
  Synthetic oligonucleotide
caaaaataagtccagattaa

SEQ ID NO: 2420 - DNA, 20 bp, Artificial sequence
  Synthetic oligonucleotide
aaaggtatttcagactgttc

SEQ ID NO: 2421 - DNA, 20 bp, Artificial sequence
  Synthetic oligonucleotide
atccaggcaaaggtatttca

SEQ ID NO: 2422 - DNA, 20 bp, Artificial sequence
  Synthetic oligonucleotide
tttcttaaaatggaaaatat

SEQ ID NO: 2423 - DNA, 20 bp, Artificial sequence
  Synthetic oligonucleotide
ttcagtgttgtgacaatatt

SEQ ID NO: 2424 - DNA, 20 bp, Artificial sequence
  Synthetic oligonucleotide
cactgtgaatatgtcctcta

SEQ ID NO: 2425 - DNA, 20 bp, Artificial sequence
  Synthetic oligonucleotide
gatttcaagtcccagaagcc

SEQ ID NO: 2426 - DNA, 20 bp, Artificial sequence
  Synthetic oligonucleotide
aatgccacatatagggtcct

SEQ ID NO: 2427 - DNA, 20 bp, Artificial sequence
  Synthetic oligonucleotide
aaggaatgccacatataggg

SEQ ID NO: 2428 - DNA, 20 bp, Artificial sequence
  Synthetic oligonucleotide
ttttcagctgccttaattac

SEQ ID NO: 2429 - DNA, 20 bp, Artificial sequence
  Synthetic oligonucleotide
cttttcagctgccttaatta

SEQ ID NO: 2430 - DNA, 20 bp, Artificial sequence
  Synthetic oligonucleotide
ttctggtttccaggtaaatg

SEQ ID NO: 2431 - DNA, 20 bp, Artificial sequence
  Synthetic oligonucleotide
cattctggtttccaggtaaa

SEQ ID NO: 2432 - DNA, 20 bp, Artificial sequence
  Synthetic oligonucleotide
cactgaccattttttaatta

SEQ ID NO: 2433 - DNA, 20 bp, Artificial sequence
  Synthetic oligonucleotide
cacactgaccattttttaat

SEQ ID NO: 2434 - DNA, 20 bp, Artificial sequence
  Synthetic oligonucleotide
ttgacaattatgagacagaa

SEQ ID NO: 2435 - DNA, 20 bp, Artificial sequence
  Synthetic oligonucleotide
ttttgacaattatgagacag

SEQ ID NO: 2436 - DNA, 20 bp, Artificial sequence
  Synthetic oligonucleotide
ttttagattgtctccctatt

SEQ ID NO: 2437 - DNA, 20 bp, Artificial sequence
  Synthetic oligonucleotide
atctccaacctaagatattt

SEQ ID NO: 2438 - DNA, 20 bp, Artificial sequence
  Synthetic oligonucleotide
cagaatttctttttccactt

SEQ ID NO: 2439 - DNA, 20 bp, Artificial sequence
  Synthetic oligonucleotide
aataattttactttaattaa

SEQ ID NO: 2440 - DNA, 20 bp, Artificial sequence
  Synthetic oligonucleotide
aataataacattgcagaaaa

SEQ ID NO: 2441 - DNA, 20 bp, Artificial sequence
  Synthetic oligonucleotide
caataataacattgcagaaa

SEQ ID NO: 2442 - DNA, 20 bp, Artificial sequence
  Synthetic oligonucleotide
tcccacatattaagtattca

SEQ ID NO: 2443 - DNA, 20 bp, Artificial sequence
  Synthetic oligonucleotide
ttcccacatattaagtattc

SEQ ID NO: 2444 - DNA, 20 bp, Artificial sequence
  Synthetic oligonucleotide
gtgcacattgtaagcctaag

SEQ ID NO: 2445 - DNA, 20 bp, Artificial sequence
  Synthetic oligonucleotide
cagtgcacattgtaagccta

SEQ ID NO: 2446 - DNA, 20 bp, Artificial sequence
  Synthetic oligonucleotide
cgttgttgatttttccagaa

SEQ ID NO: 2447 - DNA, 20 bp, Artificial sequence
  Synthetic oligonucleotide
gcgttgttgatttttccaga

SEQ ID NO: 2448 - DNA, 20 bp, Artificial sequence
  Synthetic oligonucleotide
tgattttttcctttcttcta

SEQ ID NO: 2449 - DNA, 20 bp, Artificial sequence
  Synthetic oligonucleotide
cactggtgattttttccttt

SEQ ID NO: 2450 - DNA, 20 bp, Artificial sequence
  Synthetic oligonucleotide
cttactggttagcttttttt

SEQ ID NO: 2451 - DNA, 20 bp, Artificial sequence
  Synthetic oligonucleotide
gacttgtgttagatataaat

SEQ ID NO: 2452 - DNA, 20 bp, Artificial sequence
  Synthetic oligonucleotide
tgtggaagacttgtgttaga

SEQ ID NO: 2453 - DNA, 20 bp, Artificial sequence
  Synthetic oligonucleotide
gtgtggaagacttgtgttag

SEQ ID NO: 2454 - DNA, 20 bp, Artificial sequence
  Synthetic oligonucleotide
tgactcatcattttgccatt

SEQ ID NO: 2455 - DNA, 20 bp, Artificial sequence
  Synthetic oligonucleotide
gtaaatgactcatcattttg

SEQ ID NO: 2456 - DNA, 20 bp, Artificial sequence
  Synthetic oligonucleotide
tattttggttattttaatag

SEQ ID NO: 2457 - DNA, 20 bp, Artificial sequence
  Synthetic oligonucleotide
ggtaagttctcaggagtggg

SEQ ID NO: 2458 - DNA, 20 bp, Artificial sequence
  Synthetic oligonucleotide
ccattgcaggtaagttctca

SEQ ID NO: 2459 - DNA, 20 bp, Artificial sequence
  Synthetic oligonucleotide
ttccattgcaggtaagttct

SEQ ID NO: 2460 - DNA, 20 bp, Artificial sequence
  Synthetic oligonucleotide
ttgtttgtttcttccattgc

SEQ ID NO: 2461 - DNA, 20 bp, Artificial sequence
  Synthetic oligonucleotide
tttgtttgtttcttccattg

SEQ ID NO: 2462 - DNA, 20 bp, Artificial sequence
  Synthetic oligonucleotide
acatttaggctcttttccag

SEQ ID NO: 2463 - DNA, 20 bp, Artificial sequence
  Synthetic oligonucleotide
tacatttaggctcttttcca

SEQ ID NO: 2464 - DNA, 20 bp, Artificial sequence
  Synthetic oligonucleotide
ccctggtgttatacatttag

SEQ ID NO: 2465 - DNA, 20 bp, Artificial sequence
  Synthetic oligonucleotide
tgccctggtgttatacattt

SEQ ID NO: 2466 - DNA, 20 bp, Artificial sequence
  Synthetic oligonucleotide
tagtggttacataatgttca

SEQ ID NO: 2467 - DNA, 20 bp, Artificial sequence
  Synthetic oligonucleotide
tttagtggttacataatgtt

SEQ ID NO: 2468 - DNA, 20 bp, Artificial sequence
  Synthetic oligonucleotide
tttttcacatatgcgttcac

SEQ ID NO: 2469 - DNA, 20 bp, Artificial sequence
  Synthetic oligonucleotide
atttttcacatatgcgttca

SEQ ID NO: 2470 - DNA, 20 bp, Artificial sequence
  Synthetic oligonucleotide
ttttcctttcagatttttca

SEQ ID NO: 2471 - DNA, 20 bp, Artificial sequence
  Synthetic oligonucleotide
tgcttttcctttcagatttt

SEQ ID NO: 2472 - DNA, 20 bp, Artificial sequence
  Synthetic oligonucleotide
atattcaccaaaggaaaatt

SEQ ID NO: 2473 - DNA, 20 bp, Artificial sequence
  Synthetic oligonucleotide
cttagtgagagcaatatatt

SEQ ID NO: 2474 - DNA, 20 bp, Artificial sequence
  Synthetic oligonucleotide
gtacaatctgttgtggttca

SEQ ID NO: 2475 - DNA, 20 bp, Artificial sequence
  Synthetic oligonucleotide
tgttatgttattattgttat

SEQ ID NO: 2476 - DNA, 20 bp, Artificial sequence
  Synthetic oligonucleotide
gaagttcagagaatctttca

SEQ ID NO: 2477 - DNA, 20 bp, Artificial sequence
  Synthetic oligonucleotide
aagaacttatcccaaggttg

SEQ ID NO: 2478 - DNA, 20 bp, Artificial sequence
  Synthetic oligonucleotide
gcactttctttttatttctt

SEQ ID NO: 2479 - DNA, 20 bp, Artificial sequence
  Synthetic oligonucleotide
caggctatctttctatttgt

SEQ ID NO: 2480 - DNA, 20 bp, Artificial sequence
  Synthetic oligonucleotide
atgagcacaggctatctttc

SEQ ID NO: 2481 - DNA, 20 bp, Artificial sequence
  Synthetic oligonucleotide
ctcttagatttttggacggg

SEQ ID NO: 2482 - DNA, 20 bp, Artificial sequence
  Synthetic oligonucleotide
tgctttggatctcttagatt

SEQ ID NO: 2483 - DNA, 20 bp, Artificial sequence
  Synthetic oligonucleotide
ggtagtttttcaaatcaaca

SEQ ID NO: 2484 - DNA, 20 bp, Artificial sequence
  Synthetic oligonucleotide
ggtataatttttttacctgg

SEQ ID NO: 2485 - DNA, 20 bp, Artificial sequence
  Synthetic oligonucleotide
ctctattaataggttaggaa

SEQ ID NO: 2486 - DNA, 20 bp, Artificial sequence
  Synthetic oligonucleotide
gagtatcaatttaagcaatt

SEQ ID NO: 2487 - DNA, 20 bp, Artificial sequence
  Synthetic oligonucleotide
tgtttcttttctggtagaga

SEQ ID NO: 2488 - DNA, 20 bp, Artificial sequence
  Synthetic oligonucleotide
tttcctctgtgcttattatt

SEQ ID NO: 2489 - DNA, 20 bp, Artificial sequence
  Synthetic oligonucleotide
tggaggctcttttaggtggg

SEQ ID NO: 2490 - DNA, 20 bp, Artificial sequence
  Synthetic oligonucleotide
atataccatgtacagttcaa

SEQ ID NO: 2491 - DNA, 20 bp, Artificial sequence
  Synthetic oligonucleotide
gatctgcaattgtttttctc

SEQ ID NO: 2492 - DNA, 20 bp, Artificial sequence
  Synthetic oligonucleotide
atatattcaccaaaggaaaa

SEQ ID NO: 2493 - DNA, 20 bp, Artificial sequence
  Synthetic oligonucleotide
ctgttgtggttcagctaaac

SEQ ID NO: 2494 - DNA, 20 bp, Artificial sequence
  Synthetic oligonucleotide
tgtacaatctgttgtggttc

SEQ ID NO: 2495 - DNA, 20 bp, Artificial sequence
  Synthetic oligonucleotide
ttctgttatgttattattgt

SEQ ID NO: 2496 - DNA, 20 bp, Artificial sequence
  Synthetic oligonucleotide
ctgaagttcagagaatcttt

SEQ ID NO: 2497 - DNA, 20 bp, Artificial sequence
  Synthetic oligonucleotide
agtaagaacttatcccaagg

SEQ ID NO: 2498 - DNA, 20 bp, Artificial sequence
  Synthetic oligonucleotide
ggcactttctttttatttct

SEQ ID NO: 2499 - DNA, 20 bp, Artificial sequence
  Synthetic oligonucleotide
acaggctatctttctatttg

SEQ ID NO: 2500 - DNA, 20 bp, Artificial sequence
  Synthetic oligonucleotide
ccatgagcacaggctatctt

SEQ ID NO: 2501 - DNA, 20 bp, Artificial sequence
  Synthetic oligonucleotide
atctcttagatttttggacg

SEQ ID NO: 2502 - DNA, 20 bp, Artificial sequence
  Synthetic oligonucleotide
ttgctttggatctcttagat

SEQ ID NO: 2503 - DNA, 20 bp, Artificial sequence
  Synthetic oligonucleotide
gggtggtagtttttcaaatc

SEQ ID NO: 2504 - DNA, 20 bp, Artificial sequence
  Synthetic oligonucleotide
aggtataatttttttacctg

SEQ ID NO: 2505 - DNA, 20 bp, Artificial sequence
  Synthetic oligonucleotide
gagctctattaataggttag

SEQ ID NO: 2506 - DNA, 20 bp, Artificial sequence
  Synthetic oligonucleotide
ggagtatcaatttaagcaat

SEQ ID NO: 2507 - DNA, 20 bp, Artificial sequence
  Synthetic oligonucleotide
gttgtttcttttctggtaga

SEQ ID NO: 2508 - DNA, 20 bp, Artificial sequence
  Synthetic oligonucleotide
tatttcctctgtgcttatta

SEQ ID NO: 2509 - DNA, 20 bp, Artificial sequence
  Synthetic oligonucleotide
ttttggaggctcttttaggt

SEQ ID NO: 2510 - DNA, 20 bp, Artificial sequence
  Synthetic oligonucleotide
catataccatgtacagttca

SEQ ID NO: 2511 - DNA, 20 bp, Artificial sequence
  Synthetic oligonucleotide
atgatctgcaattgtttttc

SEQ ID NO: 2512 - DNA, 20 bp, Artificial sequence
  Synthetic oligonucleotide
cattagtatactgagctcta

SEQ ID NO: 2513 - DNA, 20 bp, Artificial sequence
  Synthetic oligonucleotide
atatgtcctctagccagagg

SEQ ID NO: 2514 - DNA, 20 bp, Artificial sequence
  Synthetic oligonucleotide
catatagggtcctttaaaca

SEQ ID NO: 2515 - DNA, 20 bp, Artificial sequence
  Synthetic oligonucleotide
cattgtaagcctaaggacca

SEQ ID NO: 2516 - DNA, 20 bp, Artificial sequence
  Synthetic oligonucleotide
tctgttgtggttcagctaaa

SEQ ID NO: 2517 - DNA, 20 bp, Artificial sequence
  Synthetic oligonucleotide
aattagttacatcgggaagg

SEQ ID NO: 2518 - DNA, 20 bp, Artificial sequence
  Synthetic oligonucleotide
agatttttggacgggagatt

SEQ ID NO: 2519 - DNA, 20 bp, Artificial sequence
  Synthetic oligonucleotide
tccatcctccaggcttcggg

SEQ ID NO: 2520 - DNA, 20 bp, Artificial sequence
  Synthetic oligonucleotide
tgttttccagtgcccatcag

SEQ ID NO: 2521 - DNA, 20 bp, Artificial sequence
  Synthetic oligonucleotide
aaaaataagtccagattaac

SEQ ID NO: 2522 - DNA, 20 bp, Artificial sequence
  Synthetic oligonucleotide
aaggtatttcagactgttct

SEQ ID NO: 2523 - DNA, 20 bp, Artificial sequence
  Synthetic oligonucleotide
caatatttactcttgttgaa

SEQ ID NO: 2524 - DNA, 20 bp, Artificial sequence
  Synthetic oligonucleotide
cttaattacctatagtttaa

SEQ ID NO: 2525 - DNA, 20 bp, Artificial sequence
  Synthetic oligonucleotide
attctggtttccaggtaaat

SEQ ID NO: 2526 - DNA, 20 bp, Artificial sequence
  Synthetic oligonucleotide
tttgacaattatgagacaga

SEQ ID NO: 2527 - DNA, 20 bp, Artificial sequence
  Synthetic oligonucleotide
gaataattttactttaatta

SEQ ID NO: 2528 - DNA, 20 bp, Artificial sequence
  Synthetic oligonucleotide
ataataacattgcagaaaag

SEQ ID NO: 2529 - DNA, 20 bp, Artificial sequence
  Synthetic oligonucleotide
cccacatattaagtattcag

SEQ ID NO: 2530 - DNA, 20 bp, Artificial sequence
  Synthetic oligonucleotide
atttttccagaagtttaaca

SEQ ID NO: 2531 - DNA, 20 bp, Artificial sequence
  Synthetic oligonucleotide
ttttgccatttatctattat

SEQ ID NO: 2532 - DNA, 20 bp, Artificial sequence
  Synthetic oligonucleotide
aggtaagttctcaggagtgg

SEQ ID NO: 2533 - DNA, 20 bp, Artificial sequence
  Synthetic oligonucleotide
tgtttcttccattgcaggta

SEQ ID NO: 2534 - DNA, 20 bp, Artificial sequence
  Synthetic oligonucleotide
aggctcttttccaggtgttc

SEQ ID NO: 2535 - DNA, 20 bp, Artificial sequence
  Synthetic oligonucleotide
gttatacatttaggctcttt

SEQ ID NO: 2536 - DNA, 20 bp, Artificial sequence
  Synthetic oligonucleotide
ataattttcttagctactgc

SEQ ID NO: 2537 - DNA, 20 bp, Artificial sequence
  Synthetic oligonucleotide
cttttcctttcagatttttc

SEQ ID NO: 2538 - DNA, 20 bp, Artificial sequence
  Synthetic oligonucleotide
tatattcaccaaaggaaaat

SEQ ID NO: 2539 - DNA, 20 bp, Artificial sequence
  Synthetic oligonucleotide
tatgttattattgttatttg

SEQ ID NO: 2540 - DNA, 20 bp, Artificial sequence
  Synthetic oligonucleotide
taagaacttatcccaaggtt

SEQ ID NO: 2541 - DNA, 20 bp, Artificial sequence
  Synthetic oligonucleotide
tggatctcttagatttttgg

SEQ ID NO: 2542 - DNA, 20 bp, Artificial sequence
  Synthetic oligonucleotide
agtatcaatttaagcaattg

SEQ ID NO: 2543 - DNA, 20 bp, Artificial sequence
  Synthetic oligonucleotide
atttcctctgtgcttattat

SEQ ID NO: 2544 - DNA, 20 bp, Artificial sequence
  Synthetic oligonucleotide
tataccatgtacagttcaat

SEQ ID NO: 2545 - DNA, 20 bp, Artificial sequence
  Synthetic oligonucleotide
agccaaggttcgccataatg

SEQ ID NO: 2546 - DNA, 20 bp, Artificial sequence
  Synthetic oligonucleotide
agatagggcattagtatact

SEQ ID NO: 2547 - DNA, 20 bp, Artificial sequence
  Synthetic oligonucleotide
gaaaggaatgccacatatag

SEQ ID NO: 2548 - DNA, 20 bp, Artificial sequence
  Synthetic oligonucleotide
tcagtgcacattgtaagcct

SEQ ID NO: 2549 - DNA, 20 bp, Artificial sequence
  Synthetic oligonucleotide
atgtacaatctgttgtggtt

SEQ ID NO: 2550 - DNA, 20 bp, Artificial sequence
  Synthetic oligonucleotide
tgaagcttaattagttacat

SEQ ID NO: 2551 - DNA, 20 bp, Artificial sequence
  Synthetic oligonucleotide
ctactctatgttttccagtg

SEQ ID NO: 2552 - DNA, 20 bp, Artificial sequence
  Synthetic oligonucleotide
gttatttgctgttatacttt

SEQ ID NO: 2553 - DNA, 20 bp, Artificial sequence
  Synthetic oligonucleotide
ctaagtccaaaaataagtcc

SEQ ID NO: 2554 - DNA, 20 bp, Artificial sequence
  Synthetic oligonucleotide
tccaggcaaaggtatttcag

SEQ ID NO: 2555 - DNA, 20 bp, Artificial sequence
  Synthetic oligonucleotide
ttgtcgggttttcttaaaat

SEQ ID NO: 2556 - DNA, 20 bp, Artificial sequence
  Synthetic oligonucleotide
cagaggttcagtgttgtgac

SEQ ID NO: 2557 - DNA, 20 bp, Artificial sequence
  Synthetic oligonucleotide
ttatgttcactgtgaatatg

SEQ ID NO: 2558 - DNA, 20 bp, Artificial sequence
  Synthetic oligonucleotide
ccagaagcctttcatatatg

SEQ ID NO: 2559 - DNA, 20 bp, Artificial sequence
  Synthetic oligonucleotide
cccaaacatttgatttcaag

SEQ ID NO: 2560 - DNA, 20 bp, Artificial sequence
  Synthetic oligonucleotide
tcctgtatgtcaaaatcatt

SEQ ID NO: 2561 - DNA, 20 bp, Artificial sequence
  Synthetic oligonucleotide
aaatgcaagcagttcttttc

SEQ ID NO: 2562 - DNA, 20 bp, Artificial sequence
  Synthetic oligonucleotide
gcaagccaataataacattg

SEQ ID NO: 2563 - DNA, 20 bp, Artificial sequence
  Synthetic oligonucleotide
aagggtttcccacatattaa

SEQ ID NO: 2564 - DNA, 20 bp, Artificial sequence
  Synthetic oligonucleotide
ttttccagaagtttaacata

SEQ ID NO: 2565 - DNA, 20 bp, Artificial sequence
  Synthetic oligonucleotide
tccattgcaggtaagttctc

SEQ ID NO: 2566 - DNA, 20 bp, Artificial sequence
  Synthetic oligonucleotide
atacatttaggctcttttcc

SEQ ID NO: 2567 - DNA, 20 bp, Artificial sequence
  Synthetic oligonucleotide
gccctggtgttatacattta

SEQ ID NO: 2568 - DNA, 20 bp, Artificial sequence
  Synthetic oligonucleotide
tttctgtgcttttcctttca

SEQ ID NO: 2569 - DNA, 20 bp, Artificial sequence
  Synthetic oligonucleotide
ttagtgagagcaatatattc

SEQ ID NO: 2570 - DNA, 20 bp, Artificial sequence
  Synthetic oligonucleotide
acttctgttatgttattatt

SEQ ID NO: 2571 - DNA, 20 bp, Artificial sequence
  Synthetic oligonucleotide
tgaagttcagagaatctttc

SEQ ID NO: 2572 - DNA, 20 bp, Artificial sequence
  Synthetic oligonucleotide
agagctagtaagaacttatc

SEQ ID NO: 2573 - DNA, 20 bp, Artificial sequence
  Synthetic oligonucleotide
gtttgctttggatctcttag

SEQ ID NO: 2574 - DNA, 20 bp, Artificial sequence
  Synthetic oligonucleotide
agggtggtagtttttcaaat

SEQ ID NO: 2575 - DNA, 20 bp, Artificial sequence
  Synthetic oligonucleotide
caagtgggagtatcaattta

SEQ ID NO: 2576 - DNA, 20 bp, Artificial sequence
  Synthetic oligonucleotide
ggtttttggaggctctttta

SEQ ID NO: 2577 - DNA, 20 bp, Artificial sequence
  Synthetic oligonucleotide
tgctgggatgatctgcaatt

SEQ ID NO: 2578 - DNA, 20 bp, Artificial sequence
  Synthetic oligonucleotide
gccataatgactgctctgcc

SEQ ID NO: 2579 - DNA, 20 bp, Artificial sequence
  Synthetic oligonucleotide
atagggtcctttaaacatct

SEQ ID NO: 2580 - DNA, 20 bp, Artificial sequence
  Synthetic oligonucleotide
gttgtggttcagctaaacta

SEQ ID NO: 2581 - DNA, 20 bp, Artificial sequence
  Synthetic oligonucleotide
tttttggacgggagatttag

SEQ ID NO: 2582 - DNA, 20 bp, Artificial sequence
  Synthetic oligonucleotide
taataggttaggaagaaaag

SEQ ID NO: 2583 - DNA, 20 bp, Artificial sequence
  Synthetic oligonucleotide
ttaataggttaggaagaaaa

SEQ ID NO: 2584 - DNA, 20 bp, Artificial sequence
  Synthetic oligonucleotide
atcctccaggcttcgggcgc

SEQ ID NO: 2585 - DNA, 20 bp, Artificial sequence
  Synthetic oligonucleotide
ttatacttttactggcctgg

SEQ ID NO: 2586 - DNA, 20 bp, Artificial sequence
  Synthetic oligonucleotide
aataagtccagattaaccaa

SEQ ID NO: 2587 - DNA, 20 bp, Artificial sequence
  Synthetic oligonucleotide
gtatttcagactgttctgag

SEQ ID NO: 2588 - DNA, 20 bp, Artificial sequence
  Synthetic oligonucleotide
tatttactcttgttgaacag

SEQ ID NO: 2589 - DNA, 20 bp, Artificial sequence
  Synthetic oligonucleotide
ttcaagtcccagaagccttt

SEQ ID NO: 2590 - DNA, 20 bp, Artificial sequence
  Synthetic oligonucleotide
tttcaagtcccagaagcctt

SEQ ID NO: 2591 - DNA, 20 bp, Artificial sequence
  Synthetic oligonucleotide
aattacctatagtttaaaga

SEQ ID NO: 2592 - DNA, 20 bp, Artificial sequence
  Synthetic oligonucleotide
ctggtttccaggtaaatgga

SEQ ID NO: 2593 - DNA, 20 bp, Artificial sequence
  Synthetic oligonucleotide
tttcacaactgcagctctcc

SEQ ID NO: 2594 - DNA, 20 bp, Artificial sequence
  Synthetic oligonucleotide
gacaattatgagacagaaat

SEQ ID NO: 2595 - DNA, 20 bp, Artificial sequence
  Synthetic oligonucleotide
ctccaacctaagatattttt

SEQ ID NO: 2596 - DNA, 20 bp, Artificial sequence
  Synthetic oligonucleotide
ataacattgcagaaaagtaa

SEQ ID NO: 2597 - DNA, 20 bp, Artificial sequence
  Synthetic oligonucleotide
tttttcactgtaagaccttc

SEQ ID NO: 2598 - DNA, 20 bp, Artificial sequence
  Synthetic oligonucleotide
ttttttcactgtaagacctt

SEQ ID NO: 2599 - DNA, 20 bp, Artificial sequence
  Synthetic oligonucleotide
cttgtgttagatataaataa

SEQ ID NO: 2600 - DNA, 20 bp, Artificial sequence
  Synthetic oligonucleotide
acttgtgttagatataaata

SEQ ID NO: 2601 - DNA, 20 bp, Artificial sequence
  Synthetic oligonucleotide
ttcttccattgcaggtaagt

SEQ ID NO: 2602 - DNA, 20 bp, Artificial sequence
  Synthetic oligonucleotide
ctcttttccaggtgttctaa

SEQ ID NO: 2603 - DNA, 20 bp, Artificial sequence
  Synthetic oligonucleotide
attttcttagctactgccct

SEQ ID NO: 2604 - DNA, 20 bp, Artificial sequence
  Synthetic oligonucleotide
taatgttcatttcagttaat

SEQ ID NO: 2605 - DNA, 20 bp, Artificial sequence
  Synthetic oligonucleotide
ttttccccacatatcacagg

SEQ ID NO: 2606 - DNA, 20 bp, Artificial sequence
  Synthetic oligonucleotide
attcaccaaaggaaaattaa

SEQ ID NO: 2607 - DNA, 20 bp, Artificial sequence
  Synthetic oligonucleotide
gaatctttcaccttggtttg

SEQ ID NO: 2608 - DNA, 20 bp, Artificial sequence
  Synthetic oligonucleotide
gaacttatcccaaggttgta

SEQ ID NO: 2609 - DNA, 20 bp, Artificial sequence
  Synthetic oligonucleotide
ttctatttgtgtctccttga

SEQ ID NO: 2610 - DNA, 20 bp, Artificial sequence
  Synthetic oligonucleotide
ttttttacctggaaaatctc

SEQ ID NO: 2611 - DNA, 20 bp, Artificial sequence
  Synthetic oligonucleotide
atcaatttaagcaattgtta

SEQ ID NO: 2612 - DNA, 20 bp, Artificial sequence
  Synthetic oligonucleotide
tcctctgtgcttattattca

SEQ ID NO: 2613 - DNA, 20 bp, Artificial sequence
  Synthetic oligonucleotide
accatgtacagttcaatggt

SEQ ID NO: 2614 - DNA, 20 bp, Artificial sequence
  Synthetic oligonucleotide
ctaagatagggcattagtat

SEQ ID NO: 2615 - DNA, 20 bp, Artificial sequence
  Synthetic oligonucleotide
aaagaaaggaatgccacata

SEQ ID NO: 2616 - DNA, 20 bp, Artificial sequence
  Synthetic oligonucleotide
gattcagtgcacattgtaag

SEQ ID NO: 2617 - DNA, 20 bp, Artificial sequence
  Synthetic oligonucleotide
gatatgtacaatctgttgtg

SEQ ID NO: 2618 - DNA, 20 bp, Artificial sequence
  Synthetic oligonucleotide
atcaggagctctattaatag

SEQ ID NO: 2619 - DNA, 20 bp, Artificial sequence
  Synthetic oligonucleotide
aatcaggagctctattaata

SEQ ID NO: 2620 - DNA, 20 bp, Artificial sequence
  Synthetic oligonucleotide
ggctgcccccagtgttccat

SEQ ID NO: 2621 - DNA, 20 bp, Artificial sequence
  Synthetic oligonucleotide
cggctgcccccagtgttcca

SEQ ID NO: 2622 - DNA, 20 bp, Artificial sequence
  Synthetic oligonucleotide
ggtctactctatgttttcca

SEQ ID NO: 2623 - DNA, 20 bp, Artificial sequence
  Synthetic oligonucleotide
atggttatttgctgttatac

SEQ ID NO: 2624 - DNA, 20 bp, Artificial sequence
  Synthetic oligonucleotide
atgttgtcgggttttcttaa

SEQ ID NO: 2625 - DNA, 20 bp, Artificial sequence
  Synthetic oligonucleotide
agccagaggttcagtgttgt

SEQ ID NO: 2626 - DNA, 20 bp, Artificial sequence
  Synthetic oligonucleotide
attcccaaacatttgatttc

SEQ ID NO: 2627 - DNA, 20 bp, Artificial sequence
  Synthetic oligonucleotide
ctctcctgtatgtcaaaatc

SEQ ID NO: 2628 - DNA, 20 bp, Artificial sequence
  Synthetic oligonucleotide
tatgatgatggtgctttcac

SEQ ID NO: 2629 - DNA, 20 bp, Artificial sequence
  Synthetic oligonucleotide
taattctggtttttgacaat

SEQ ID NO: 2630 - DNA, 20 bp, Artificial sequence
  Synthetic oligonucleotide
ttttttagattgtctcccta

SEQ ID NO: 2631 - DNA, 20 bp, Artificial sequence
  Synthetic oligonucleotide
caaaagggtttcccacatat

SEQ ID NO: 2632 - DNA, 20 bp, Artificial sequence
  Synthetic oligonucleotide
ttccactggtgattttttcc

SEQ ID NO: 2633 - DNA, 20 bp, Artificial sequence
  Synthetic oligonucleotide
tttccactggtgattttttc

SEQ ID NO: 2634 - DNA, 20 bp, Artificial sequence
  Synthetic oligonucleotide
ccttactggttagctttttt

SEQ ID NO: 2635 - DNA, 20 bp, Artificial sequence
  Synthetic oligonucleotide
cccttactggttagcttttt

SEQ ID NO: 2636 - DNA, 20 bp, Artificial sequence
  Synthetic oligonucleotide
ttcggtgtggaagacttgtg

SEQ ID NO: 2637 - DNA, 20 bp, Artificial sequence
  Synthetic oligonucleotide
tttcggtgtggaagacttgt

SEQ ID NO: 2638 - DNA, 20 bp, Artificial sequence
  Synthetic oligonucleotide
tcttccattgcaggtaagtt

SEQ ID NO: 2639 - DNA, 20 bp, Artificial sequence
  Synthetic oligonucleotide
actgccctggtgttatacat

SEQ ID NO: 2640 - DNA, 20 bp, Artificial sequence
  Synthetic oligonucleotide
gttaatgtgtcataattttc

SEQ ID NO: 2641 - DNA, 20 bp, Artificial sequence
  Synthetic oligonucleotide
tttttagtggttacataatg

SEQ ID NO: 2642 - DNA, 20 bp, Artificial sequence
  Synthetic oligonucleotide
atttttagtggttacataat

SEQ ID NO: 2643 - DNA, 20 bp, Artificial sequence
  Synthetic oligonucleotide
ttttacttgtcagtttttcc

SEQ ID NO: 2644 - DNA, 20 bp, Artificial sequence
  Synthetic oligonucleotide
tttttacttgtcagtttttc

SEQ ID NO: 2645 - DNA, 20 bp, Artificial sequence
  Synthetic oligonucleotide
tttcctttcagatttttcac

SEQ ID NO: 2646 - DNA, 20 bp, Artificial sequence
  Synthetic oligonucleotide
actgaattttctctcccagc

SEQ ID NO: 2647 - DNA, 20 bp, Artificial sequence
  Synthetic oligonucleotide
cgtccattttctgtgctttt

SEQ ID NO: 2648 - DNA, 20 bp, Artificial sequence
  Synthetic oligonucleotide
  misc_feature (1)..(1): bases at these positions are RNA
  misc_feature (3)..(5): bases at these positions are RNA
  misc_feature (7)..(7): bases at these positions are RNA
  misc_feature (11)..(17): bases at these positions are RNA
  misc_feature (19)..(19): bases at these positions are RNA
gtcagtutttccccacatat

SEQ ID NO: 2649 - DNA, 20 bp, Artificial sequence
  Synthetic oligonucleotide
ataatgactgcctcggtcgt

SEQ ID NO: 2650 - DNA, 20 bp, Artificial sequence
  Synthetic oligonucleotide
ccataatgactgcctcggtc

SEQ ID NO: 2651 - DNA, 20 bp, Artificial sequence
  Synthetic oligonucleotide
cataatgactgctctgcaaa

SEQ ID NO: 2652 - DNA, 20 bp, Artificial sequence
  Synthetic oligonucleotide
ttcgccataatgactgcctc

SEQ ID NO: 2653 - DNA, 20 bp, Artificial sequence
  Synthetic oligonucleotide
ccataatgactgctctgcaa

SEQ ID NO: 2654 - DNA, 20 bp, Artificial sequence
  Synthetic oligonucleotide
gttcgccataatgactgcct

SEQ ID NO: 2655 - DNA, 20 bp, Artificial sequence
  Synthetic oligonucleotide
attagtgtgatcatgcacat

SEQ ID NO: 2656 - DNA, 20 bp, Artificial sequence
  Synthetic oligonucleotide
acagccatgttcagtgtcag

SEQ ID NO: 2657 - DNA, 20 bp, Artificial sequence
  Synthetic oligonucleotide
ttgattgtgatattgacgca

SEQ ID NO: 2658 - DNA, 20 bp, Artificial sequence
  Synthetic oligonucleotide
catgttttcacgatagtaac

SEQ ID NO: 2659 - DNA, 20 bp, Artificial sequence
  Synthetic oligonucleotide
tattcatgttctccacggga

SEQ ID NO: 2660 - DNA, 20 bp, Artificial sequence
  Synthetic oligonucleotide
aaaatgtttgtcactggttc

SEQ ID NO: 2661 - DNA, 20 bp, Artificial sequence
  Synthetic oligonucleotide
agaagataatcaagggtgca

SEQ ID NO: 2662 - DNA, 20 bp, Artificial sequence
  Synthetic oligonucleotide
atcctgatgtcaaagtccca

SEQ ID NO: 2663 - DNA, 20 bp, Artificial sequence
  Synthetic oligonucleotide
aggtgctgtccaaggccata

SEQ ID NO: 2664 - DNA, 20 bp, Artificial sequence
  Synthetic oligonucleotide
ttagtcttgtcctcagtgct

SEQ ID NO: 2665 - DNA, 20 bp, Artificial sequence
  Synthetic oligonucleotide
tggttgctgtactcatccat

SEQ ID NO: 2666 - DNA, 20 bp, Artificial sequence
  Synthetic oligonucleotide
gcatgttttcacgatagtaa

SEQ ID NO: 2667 - DNA, 20 bp, Artificial sequence
  Synthetic oligonucleotide
aactgtgggtccatttcatc

SEQ ID NO: 2668 - DNA, 20 bp, Artificial sequence
  Synthetic oligonucleotide
tgaccatcttattcggtgct

SEQ ID NO: 2669 - DNA, 20 bp, Artificial sequence
  Synthetic oligonucleotide
tctatggaatctgtaggtca

SEQ ID NO: 2670 - DNA, 20 bp, Artificial sequence
  Synthetic oligonucleotide
caattagtgtgatcatgcac

SEQ ID NO: 2671 - DNA, 20 bp, Artificial sequence
  Synthetic oligonucleotide
ttttctgtgacatttggtga

SEQ ID NO: 2672 - DNA, 20 bp, Artificial sequence
  Synthetic oligonucleotide
gcttccatcacttctcacct

SEQ ID NO: 2673 - DNA, 20 bp, Artificial sequence
  Synthetic oligonucleotide
tttctgtgacatttggtgac

SEQ ID NO: 2674 - DNA, 20 bp, Artificial sequence
  Synthetic oligonucleotide
gacagccatgttcagtgtca

SEQ ID NO: 2675 - DNA, 20 bp, Artificial sequence
  Synthetic oligonucleotide
ggtttctgggtcacagcttc

SEQ ID NO: 2676 - DNA, 20 bp, Artificial sequence
  Synthetic oligonucleotide
aaggtgctgtccaaggccat

SEQ ID NO: 2677 - DNA, 20 bp, Artificial sequence
  Synthetic oligonucleotide
ttcctctgtgcttattattc

SEQ ID NO: 2678 - DNA, 20 bp, Artificial sequence
  Synthetic oligonucleotide
ggttgttctataaattcatc

SEQ ID NO: 2679 - DNA, 20 bp, Artificial sequence
  Synthetic oligonucleotide
acatttatttcatgtgccag

SEQ ID NO: 2680 - DNA, 20 bp, Artificial sequence
  Synthetic oligonucleotide
caaggtgctgtccaaggcca

SEQ ID NO: 2681 - DNA, 20 bp, Artificial sequence
  Synthetic oligonucleotide
ctgaagttagtcttgtcctc

SEQ ID NO: 2682 - DNA, 20 bp, Artificial sequence
  Synthetic oligonucleotide
gttagtcttgtcctcagtgc

SEQ ID NO: 2683 - DNA, 20 bp, Artificial sequence
  Synthetic oligonucleotide
ctcaaggtgctgtccaaggc

SEQ ID NO: 2684 - DNA, 20 bp, Artificial sequence
  Synthetic oligonucleotide
ttagtgtgatcatgcacata

SEQ ID NO: 2685 - DNA, 20 bp, Artificial sequence
  Synthetic oligonucleotide
catttatttcatgtgccagc

SEQ ID NO: 2686 - DNA, 20 bp, Artificial sequence
  Synthetic oligonucleotide
aagttagtcttgtcctcagt

SEQ ID NO: 2687 - DNA, 20 bp, Artificial sequence
  Synthetic oligonucleotide
ccccacatatcacaggctcc

SEQ ID NO: 2688 - DNA, 20 bp, Artificial sequence
  Synthetic oligonucleotide
ctttcctgatagttcactgt

SEQ ID NO: 2689 - DNA, 20 bp, Artificial sequence
  Synthetic oligonucleotide
agattcttgttcagcacgat

SEQ ID NO: 2690 - DNA, 20 bp, Artificial sequence
  Synthetic oligonucleotide
cggtgcatgttttcacgata

SEQ ID NO: 2691 - DNA, 20 bp, Artificial sequence
  Synthetic oligonucleotide
ttgacagccatgttcagtgt

SEQ ID NO: 2692 - DNA, 20 bp, Artificial sequence
  Synthetic oligonucleotide
gtgcatgttttcacgatagt

SEQ ID NO: 2693 - DNA, 20 bp, Artificial sequence
  Synthetic oligonucleotide
tgcttccatcacttctcacc

SEQ ID NO: 2694 - DNA, 20 bp, Artificial sequence
  Synthetic oligonucleotide
tttctagaacttgcaaggaa

SEQ ID NO: 2695 - DNA, 20 bp, Artificial sequence
  Synthetic oligonucleotide
cctgatagttcactgttggc

SEQ ID NO: 2696 - DNA, 20 bp, Artificial sequence
  Synthetic oligonucleotide
tctatttgtgtctccttgaa

SEQ ID NO: 2697 - DNA, 20 bp, Artificial sequence
  Synthetic oligonucleotide
ttcttagctactgccctggt

SEQ ID NO: 2698 - DNA, 20 bp, Artificial sequence
  Synthetic oligonucleotide
tttttagattgtctccctat

SEQ ID NO: 2699 - DNA, 20 bp, Artificial sequence
  Synthetic oligonucleotide
atttttccaacatgaccatc

SEQ ID NO: 2700 - DNA, 20 bp, Artificial sequence
  Synthetic oligonucleotide
cacaactgcagctctcctgt

SEQ ID NO: 2701 - DNA, 20 bp, Artificial sequence
  Synthetic oligonucleotide
gctcctcaaactgacaagcc

SEQ ID NO: 2702 - DNA, 20 bp, Artificial sequence
  Synthetic oligonucleotide
ttgctcctttccactggtga

SEQ ID NO: 2703 - DNA, 20 bp, Artificial sequence
  Synthetic oligonucleotide
gcaccttctccattcgctgc

SEQ ID NO: 2704 - DNA, 20 bp, Artificial sequence
  Synthetic oligonucleotide
ggtgcttccatcacttctca

SEQ ID NO: 2705 - DNA, 20 bp, Artificial sequence
  Synthetic oligonucleotide
gctcatggcacttcccagca

SEQ ID NO: 2706 - DNA, 20 bp, Artificial sequence
  Synthetic oligonucleotide
gccaccttcacccaatttta

SEQ ID NO: 2707 - DNA, 20 bp, Artificial sequence
  Synthetic oligonucleotide
gagcctgcatcccaagagct

SEQ ID NO: 2708 - DNA, 20 bp, Artificial sequence
  Synthetic oligonucleotide
gggcaccatcccctcagtca

SEQ ID NO: 2709 - DNA, 20 bp, Artificial sequence
  Synthetic oligonucleotide
gcttgaccagcatctcaggt

SEQ ID NO: 2710 - DNA, 20 bp, Artificial sequence
  Synthetic oligonucleotide
ctgtagccatcactgggtta

SEQ ID NO: 2711 - DNA, 20 bp, Artificial sequence
  Synthetic oligonucleotide
ctgacaagcccatcctgtct

SEQ ID NO: 2712 - DNA, 20 bp, Artificial sequence
  Synthetic oligonucleotide
tcctcatcccactatcagga

SEQ ID NO: 2713 - DNA, 20 bp, Artificial sequence
  Synthetic oligonucleotide
cctccattctatgaatggac

SEQ ID NO: 2714 - DNA, 20 bp, Artificial sequence
  Synthetic oligonucleotide
cccccaataactcatacata

SEQ ID NO: 2715 - DNA, 20 bp, Artificial sequence
  Synthetic oligonucleotide
cggtgcttccatcacttctc

SEQ ID NO: 2716 - DNA, 20 bp, Artificial sequence
  Synthetic oligonucleotide
tctcaggtctactctatgtt

SEQ ID NO: 2717 - DNA, 20 bp, Artificial sequence
  Synthetic oligonucleotide
gttcaggcctcccactgctc

SEQ ID NO: 2718 - DNA, 20 bp, Artificial sequence
  Synthetic oligonucleotide
ccaagagctaagaatctcta

SEQ ID NO: 2719 - DNA, 20 bp, Artificial sequence
  Synthetic oligonucleotide
gtgaacaataatctattgct

SEQ ID NO: 2720 - DNA, 20 bp, Artificial sequence
  Synthetic oligonucleotide
ctgtactcatccatgggcct

SEQ ID NO: 2721 - DNA, 20 bp, Artificial sequence
  Synthetic oligonucleotide
gtgactttcaaccttcctaa

SEQ ID NO: 2722 - DNA, 20 bp, Artificial sequence
  Synthetic oligonucleotide
tcaggtctactctatgtttt

SEQ ID NO: 2723 - DNA, 20 bp, Artificial sequence
  Synthetic oligonucleotide
ctcaggtctactctatgttt

SEQ ID NO: 2724 - DNA, 20 bp, Artificial sequence
  Synthetic oligonucleotide
ttccagcttcttaatgcatc

SEQ ID NO: 2725 - DNA, 20 bp, Artificial sequence
  Synthetic oligonucleotide
ctccttgaatttctttcatc

SEQ ID NO: 2726 - DNA, 20 bp, Artificial sequence
  Synthetic oligonucleotide
gcttctcaatttttccaaca

SEQ ID NO: 2727 - DNA, 20 bp, Artificial sequence
  Synthetic oligonucleotide
tctttctaattttgtacaca

SEQ ID NO: 2728 - DNA, 20 bp, Artificial sequence
  Synthetic oligonucleotide
gttgttctataaattcatct

SEQ ID NO: 2729 - DNA, 20 bp, Artificial sequence
  Synthetic oligonucleotide
tccttgaatttctttcatca

SEQ ID NO: 2730 - DNA, 20 bp, Artificial sequence
  Synthetic oligonucleotide
ccattttttaattacatcat

SEQ ID NO: 2731 - DNA, 20 bp, Artificial sequence
  Synthetic oligonucleotide
tctccttgaatttctttcat

SEQ ID NO: 2732 - DNA, 20 bp, Artificial sequence
  Synthetic oligonucleotide
tctgagatttgttttagcct

SEQ ID NO: 2733 - DNA, 20 bp, Artificial sequence
  Synthetic oligonucleotide
caattgtttttctctctctc

SEQ ID NO: 2734 - DNA, 20 bp, Artificial sequence
  Synthetic oligonucleotide
tctcaattttttgagaagtt

SEQ ID NO: 2735 - DNA, 20 bp, Artificial sequence
  Synthetic oligonucleotide
tctcaatttttccaacatga

SEQ ID NO: 2736 - DNA, 20 bp, Artificial sequence
  Synthetic oligonucleotide
ccattttctgtgcttttcct

SEQ ID NO: 2737 - DNA, 20 bp, Artificial sequence
  Synthetic oligonucleotide
tccattttctgtgcttttcc

SEQ ID NO: 2738 - DNA, 20 bp, Artificial sequence
  Synthetic oligonucleotide
gtccattttctgtgcttttc

SEQ ID NO: 2739 - DNA, 20 bp, Artificial sequence
  Synthetic oligonucleotide
acgtccattttctgtgcttt

SEQ ID NO: 2740 - DNA, 20 bp, Artificial sequence
  Synthetic oligonucleotide
aacgtccattttctgtgctt

SEQ ID NO: 2741 - DNA, 20 bp, Artificial sequence
  Synthetic oligonucleotide
aaacgtccattttctgtgct

SEQ ID NO: 2742 - DNA, 20 bp, Artificial sequence
  Synthetic oligonucleotide
  misc_feature (1)..(2): bases at these positions are RNA
  misc_feature (5)..(10): bases at these positions are RNA
  misc_feature (12)..(12): bases at these positions are RNA
  misc_feature (15)..(16): bases at these positions are RNA
  misc_feature (20)..(20): bases at these positions are RNA
ggttacauaatgttcatttc

SEQ ID NO: 2743 - DNA, 20 bp, Artificial sequence
  Synthetic oligonucleotide
  misc_feature (2)..(6): bases at these positions are RNA
  misc_feature (8)..(8): bases at these positions are RNA
  misc_feature (10)..(10): bases at these positions are RNA
  misc_feature (16)..(16): bases at these positions are RNA
  misc_feature (20)..(20): bases at these positions are RNA
tggcactutctttttatttc

SEQ ID NO: 2744 - DNA, 20 bp, Artificial sequence
  Synthetic oligonucleotide
  misc_feature (1)..(2): bases at these positions are RNA
  misc_feature (4)..(7): bases at these positions are RNA
  misc_feature (11)..(11): bases at these positions are RNA
  misc_feature (13)..(13): bases at these positions are RNA
  misc_feature (15)..(16): bases at these positions are RNA
cgtccautttctgtgctttt

SEQ ID NO: 2745 - DNA, 19 bp, Artificial sequence
  Synthetic oligonucleotide
gtcagtttttccccacata

SEQ ID NO: 2746 - DNA, 19 bp, Artificial sequence
  Synthetic oligonucleotide
ctctatgttttccagtgcc

SEQ ID NO: 2747 - DNA, 19 bp, Artificial sequence
  Synthetic oligonucleotide
gcacactgaccatttttta

SEQ ID NO: 2748 - DNA, 19 bp, Artificial sequence
  Synthetic oligonucleotide
actctatgttttccagtgc

SEQ ID NO: 2749 - DNA, 19 bp, Artificial sequence
  Synthetic oligonucleotide
tgtcagtttttccccacat

SEQ ID NO: 2750 - DNA, 19 bp, Artificial sequence
  Synthetic oligonucleotide
gtcataattttcttagcta

SEQ ID NO: 2751 - DNA, 19 bp, Artificial sequence
  Synthetic oligonucleotide
ctatgttttccagtgccca

SEQ ID NO: 2752 - DNA, 19 bp, Artificial sequence
  Synthetic oligonucleotide
tctatgttttccagtgccc

SEQ ID NO: 2753 - DNA, 19 bp, Artificial sequence
  Synthetic oligonucleotide
ctgaattttctctcccagc

SEQ ID NO: 2754 - DNA, 19 bp, Artificial sequence
  Synthetic oligonucleotide
ccacatatagggtccttta

SEQ ID NO: 2755 - DNA, 19 bp, Artificial sequence
  Synthetic oligonucleotide
gccacatatagggtccttt

SEQ ID NO: 2756 - DNA, 19 bp, Artificial sequence
  Synthetic oligonucleotide
actgaattttctctcccag

SEQ ID NO: 2757 - DNA, 19 bp, Artificial sequence
  Synthetic oligonucleotide
cttattattcatgttctcc

SEQ ID NO: 2758 - DNA, 19 bp, Artificial sequence
  Synthetic oligonucleotide
cttactcggcttgttccac

SEQ ID NO: 2759 - DNA, 19 bp, Artificial sequence
  Synthetic oligonucleotide
tgtcataattttcttagct

SEQ ID NO: 2760 - DNA, 19 bp, Artificial sequence
  Synthetic oligonucleotide
tcataattttcttagctac

SEQ ID NO: 2761 - DNA, 19 bp, Artificial sequence
  Synthetic oligonucleotide
cacactgaccattttttaa

SEQ ID NO: 2762 - DNA, 19 bp, Artificial sequence
  Synthetic oligonucleotide
tcagtttttccccacatat

SEQ ID NO: 2763 - DNA, 19 bp, Artificial sequence
  Synthetic oligonucleotide
tatgttttccagtgcccat

SEQ ID NO: 2764 - DNA, 19 bp, Artificial sequence
  Synthetic oligonucleotide
gtgtcataattttcttagc

SEQ ID NO: 2765 - DNA, 19 bp, Artificial sequence
  Synthetic oligonucleotide
gcttattattcatgttctc

SEQ ID NO: 2766 - DNA, 19 bp, Artificial sequence
  Synthetic oligonucleotide
gcttactcggcttgttcca

SEQ ID NO: 2767 - DNA, 18 bp, Artificial sequence
  Synthetic oligonucleotide
cagtttttccccacatat

SEQ ID NO: 2768 - DNA, 18 bp, Artificial sequence
  Synthetic oligonucleotide
ctatgttttccagtgccc

SEQ ID NO: 2769 - DNA, 18 bp, Artificial sequence
  Synthetic oligonucleotide
gtcagtttttccccacat

SEQ ID NO: 2770 - DNA, 18 bp, Artificial sequence
  Synthetic oligonucleotide
tcagtttttccccacata

SEQ ID NO: 2771 - DNA, 18 bp, Artificial sequence
  Synthetic oligonucleotide
ccacatatagggtccttt

SEQ ID NO: 2772 - DNA, 18 bp, Artificial sequence
  Synthetic oligonucleotide
cacatatagggtccttta

SEQ ID NO: 2773 - DNA, 18 bp, Artificial sequence
  Synthetic oligonucleotide
actgaattttctctccca

SEQ ID NO: 2774 - DNA, 18 bp, Artificial sequence
  Synthetic oligonucleotide
tgaattttctctcccagc

SEQ ID NO: 2775 - DNA, 18 bp, Artificial sequence
  Synthetic oligonucleotide
ctgaattttctctcccag

SEQ ID NO: 2776 - DNA, 18 bp, Artificial sequence
  Synthetic oligonucleotide
gccacatatagggtcctt

SEQ ID NO: 2777 - DNA, 18 bp, Artificial sequence
  Synthetic oligonucleotide
actctatgttttccagtg

SEQ ID NO: 2778 - DNA, 18 bp, Artificial sequence
  Synthetic oligonucleotide
tctatgttttccagtgcc

SEQ ID NO: 2779 - DNA, 18 bp, Artificial sequence
  Synthetic oligonucleotide
ctctatgttttccagtgc

SEQ ID NO: 2780 - DNA, 18 bp, Artificial sequence
  Synthetic oligonucleotide
  misc_feature (1)..(1): bases at these positions are RNA
  misc_feature (3)..(3): bases at these positions are RNA
  misc_feature (5)..(5): bases at these positions are RNA
  misc_feature (7)..(7): bases at these positions are RNA
  misc_feature (10)..(13): bases at these positions are RNA
  misc_feature (15)..(18): bases at these positions are RNA
ctatgtuttccagtgccc

SEQ ID NO: 2781 - DNA, 17 bp, Artificial sequence
  Synthetic oligonucleotide
actctatgttttccagt

SEQ ID NO: 2782 - DNA, 17 bp, Artificial sequence
  Synthetic oligonucleotide
tctatgttttccagtgc

SEQ ID NO: 2783 - DNA, 17 bp, Artificial sequence
  Synthetic oligonucleotide
ctctatgttttccagtg

SEQ ID NO: 2784 - DNA, 17 bp, Artificial sequence
  Synthetic oligonucleotide
acatatagggtccttta

SEQ ID NO: 2785 - DNA, 17 bp, Artificial sequence
  Synthetic oligonucleotide
gccacatatagggtcct

SEQ ID NO: 2786 - DNA, 17 bp, Artificial sequence
  Synthetic oligonucleotide
cacatatagggtccttt

SEQ ID NO: 2787 - DNA, 17 bp, Artificial sequence
  Synthetic oligonucleotide
ccacatatagggtcctt

SEQ ID NO: 2788 - DNA, 17 bp, Artificial sequence
  Synthetic oligonucleotide
ataattttcttagctac

SEQ ID NO: 2789 - DNA, 17 bp, Artificial sequence
  Synthetic oligonucleotide
gtcataattttcttagc

SEQ ID NO: 2790 - DNA, 17 bp, Artificial sequence
  Synthetic oligonucleotide
cataattttcttagcta

SEQ ID NO: 2791 - DNA, 17 bp, Artificial sequence
  Synthetic oligonucleotide
tcataattttcttagct

SEQ ID NO: 2792 - DNA, 17 bp, Artificial sequence
  Synthetic oligonucleotide
gtgtcataattttctta

SEQ ID NO: 2793 - DNA, 17 bp, Artificial sequence
  Synthetic oligonucleotide
tgtcataattttcttag

SEQ ID NO: 2794 - DNA, 17 bp, Artificial sequence
  Synthetic oligonucleotide
tattattcatgttctcc

SEQ ID NO: 2795 - DNA, 17 bp, Artificial sequence
  Synthetic oligonucleotide
gcttattattcatgttc

SEQ ID NO: 2796 - DNA, 17 bp, Artificial sequence
  Synthetic oligonucleotide
ttattattcatgttctc

SEQ ID NO: 2797 - DNA, 17 bp, Artificial sequence
  Synthetic oligonucleotide
cttattattcatgttct

SEQ ID NO: 2798 - DNA, 17 bp, Artificial sequence
  Synthetic oligonucleotide
ccattttctgtgctttt

SEQ ID NO: 2799 - DNA, 17 bp, Artificial sequence
  Synthetic oligonucleotide
cgtccattttctgtgct

SEQ ID NO: 2800 - DNA, 17 bp, Artificial sequence
  Synthetic oligonucleotide
tccattttctgtgcttt

SEQ ID NO: 2801 - DNA, 17 bp, Artificial sequence
  Synthetic oligonucleotide
gtccattttctgtgctt

SEQ ID NO: 2802 - DNA, 17 bp, Artificial sequence
  Synthetic oligonucleotide
ctatgttttccagtgcc

SEQ ID NO: 2803 - DNA, 16 bp, Artificial sequence
  Synthetic oligonucleotide
gtcataattttcttag

SEQ ID NO: 2804 - DNA, 16 bp, Artificial sequence
  Synthetic oligonucleotide
cataattttcttagct

SEQ ID NO: 2805 - DNA, 16 bp, Artificial sequence
  Synthetic oligonucleotide
tcataattttcttagc

SEQ ID NO: 2806 - DNA, 16 bp, Artificial sequence
  Synthetic oligonucleotide
ataattttcttagcta

The invention claimed is:
1. A modified oligonucleotide according to the following chemical structure:

(SEQ ID NO: 2302)

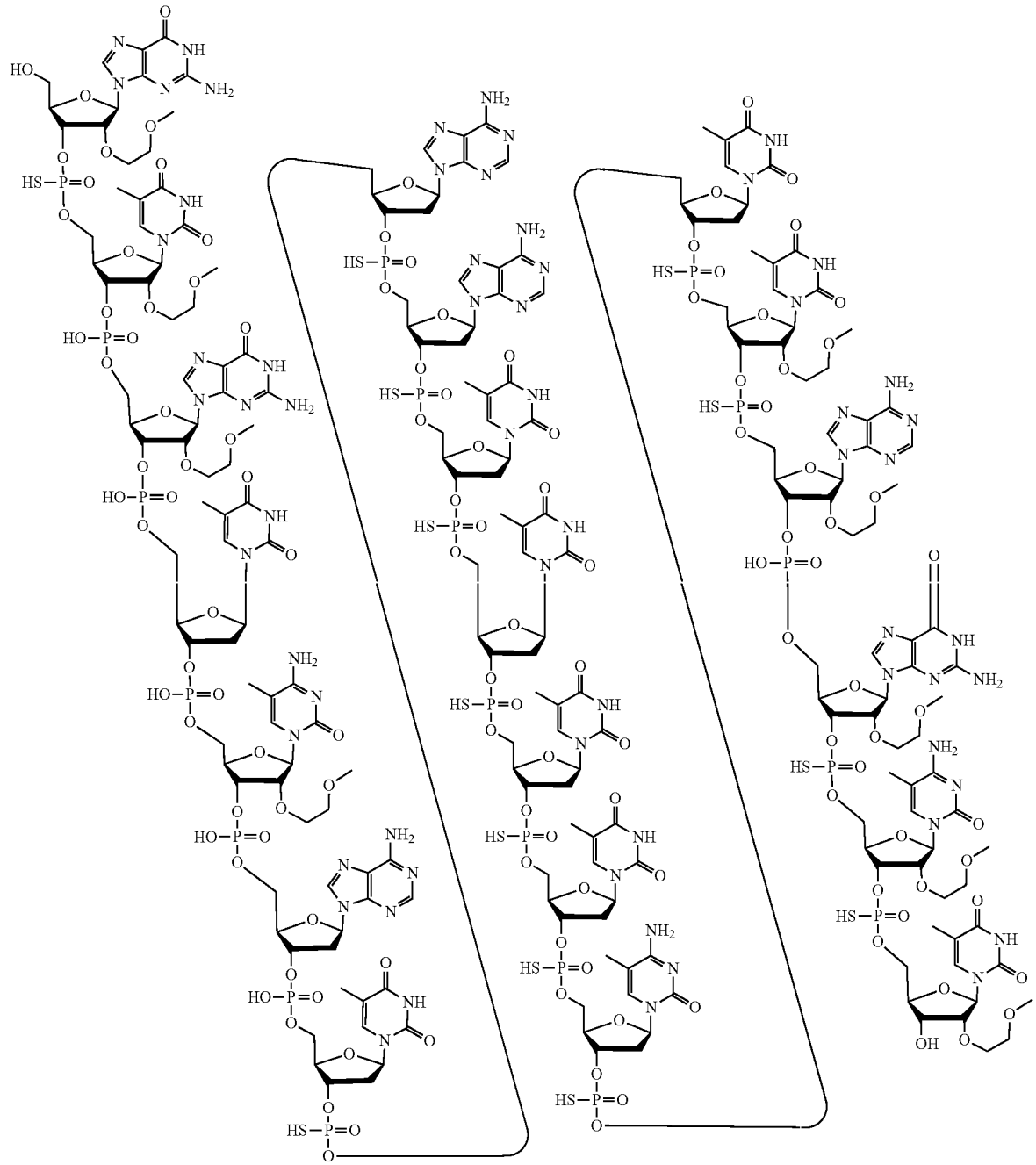

or a salt thereof.

2. The modified oligonucleotide of claim 1, which is the sodium salt of the potassium salt.

3. A pharmaceutical composition comprising the modified oligonucleotide of claim 1, and a pharmaceutically acceptable diluent.

4. The pharmaceutical composition of claim 3, wherein the pharmaceutically acceptable diluent is artificial cerebrospinal fluid.

5. The pharmaceutical composition of claim 4, wherein the pharmaceutical composition consists essentially of the modified oligonucleotide and artificial cerebrospinal fluid.

6. A population of modified oligonucleotides of claim 1, wherein all of the phosphorothioate internucleoside linkages of the modified oligonucleotide are stereorandom.

7. A pharmaceutical composition comprising the population of modified oligonucleotides of claim 6, and a pharmaceutically acceptable diluent.

8. The pharmaceutical composition of claim 7, wherein the pharmaceutically acceptable diluent is artificial cerebrospinal fluid.

9. The pharmaceutical composition of claim 8, wherein the pharmaceutical composition consists essentially of the population of modified oligonucleotides and artificial cerebrospinal fluid.

10. A modified oligonucleotide according to the following chemical structure:

12. The pharmaceutical composition of claim 11, wherein the pharmaceutically acceptable diluent is artificial cerebrospinal fluid.

13. The pharmaceutical composition of claim 12, wherein the pharmaceutical composition consists essentially of the modified oligonucleotide and artificial cerebrospinal fluid.

(SEQ ID NO: 2302)

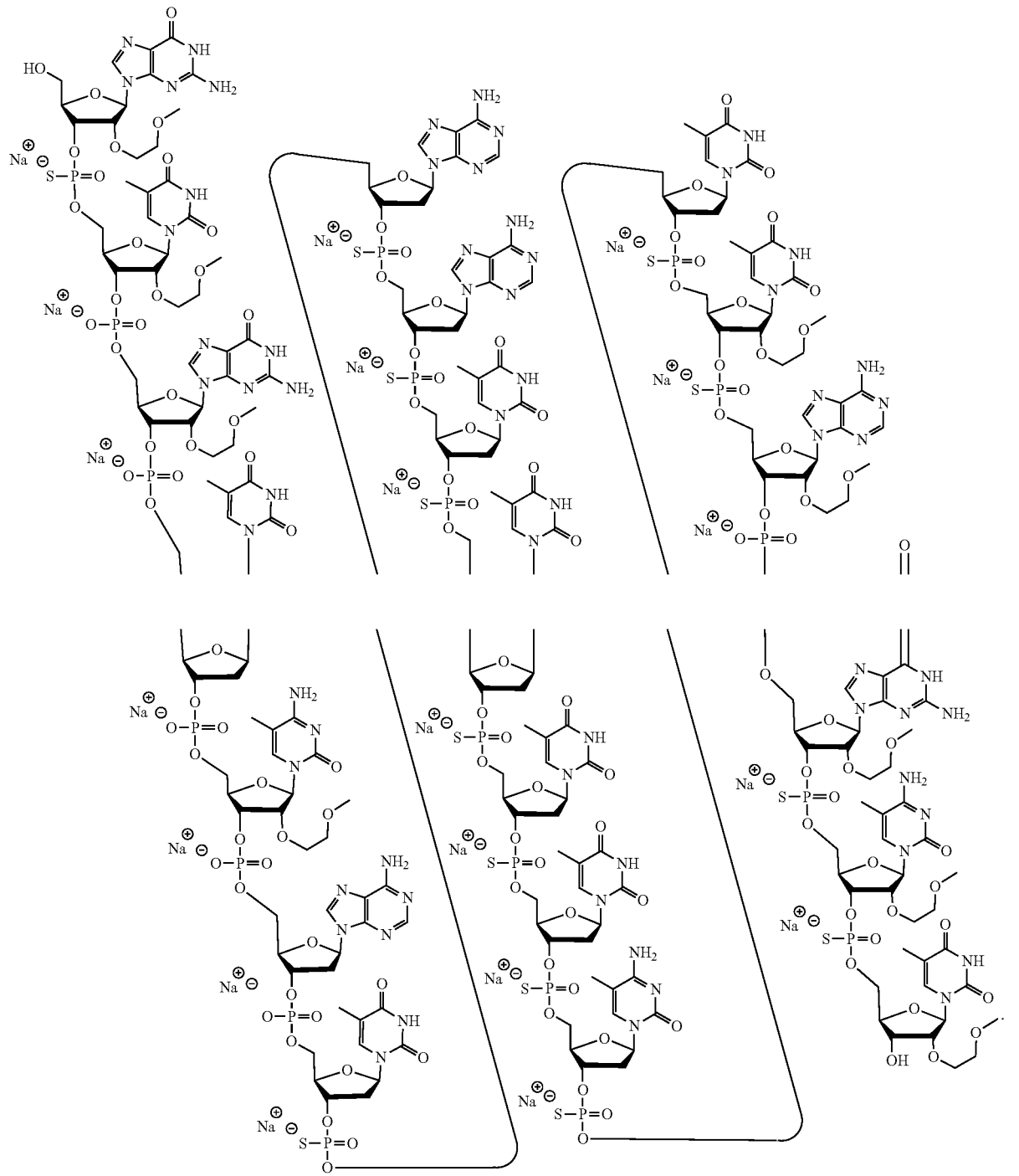

11. A pharmaceutical composition comprising the modified oligonucleotide of claim 10 and a pharmaceutically acceptable diluent.

14. A population of modified oligonucleotides of claim 10, wherein all of the phosphorothioate internucleoside linkages of the modified oligonucleotide are stereorandom.

15. A pharmaceutical composition comprising the population of modified oligonucleotides of claim 14, and a pharmaceutically acceptable diluent.

16. The pharmaceutical composition of claim 15, wherein the pharmaceutically acceptable diluent is artificial cerebrospinal fluid.

17. The pharmaceutical composition of claim 16, wherein the pharmaceutical composition consists essentially of the population of modified oligonucleotides and artificial cerebrospinal fluid.

18. A compound comprising a modified oligonucleotide according to the following chemical notation: Ges Teo Geo Teo $^m$Ceo Aeo Tds Ads Ads Tds Tds Tds Tds $^m$Cds Tds Tds Aeo Ges $^m$Ces Te (SEQ ID NO: 2302), wherein,
   A=an adenine nucleobase,
   mC=a 5-methylcytosine nucleobase,
   G=a guanine nucleobase,
   T=a thymine nucleobase,
   e=a 2'-MOE modified sugar,
   d=a 2'-β-D deoxyribosyl sugar,
   s=a phosphorothioate internucleoside linkage, and
   o=a phosphodiester internucleoside linkage.

19. A pharmaceutical composition comprising a compound of claim 18, and a pharmaceutically acceptable diluent.

20. The pharmaceutical composition of claim 19, wherein the pharmaceutically acceptable diluent is artificial cerebrospinal fluid.

21. The pharmaceutical composition of claim 20, wherein the pharmaceutical composition consists essentially of the compound and artificial cerebrospinal fluid.

22. The compound of claim 18, comprising the modified oligonucleotide covalently linked to a conjugate group.

23. A pharmaceutical composition comprising a compound of claim 22, and a pharmaceutically acceptable diluent.

24. The pharmaceutical composition of claim 23, wherein the pharmaceutically acceptable diluent is artificial cerebrospinal fluid.

25. The pharmaceutical composition of claim 24, wherein the pharmaceutical composition consists essentially of the compound and artificial cerebrospinal fluid.

26. A population of compounds of claim 18, wherein all of the phosphorothioate internucleoside linkages of the compound are stereorandom.

27. A pharmaceutical composition comprising the population of compounds of claim 26, and a pharmaceutically acceptable diluent.

28. The pharmaceutical composition of claim 27, wherein the pharmaceutically acceptable diluent is artificial cerebrospinal fluid.

29. The pharmaceutical composition of claim 28, wherein the pharmaceutical composition consists essentially of the population of compounds and artificial cerebrospinal fluid.

\* \* \* \* \*